United States Patent 10,233,465 (OPTIMAL SOYBEAN LOCI) - sequence listing, part 4

SEQ ID NO: 6023 - DNA, 1000 bp, Glycine max
  Soy_ogl_4490 Gm13:36590401..36591400 Cluster 26
gtcacaaccctttgattgtaattatcatatggacggttcatagtaattttggcaccctagcccacgtcatgtttgaatccctatatataattgtactatgttatattttggtctctgtacgtgcataacttttatgttttagtccctagacttgaaagtagttaatccgttttggtccctatgcataaacatttattttttatgttttggtctttatcggcaccgcttcccttttttcctcttataccaccaaccaattgaccataatcaaagagagtcttgaggttgcagggttcttaagcaattcatggacaagacgacgaggttgtctgttagtagcaatttatgctggcattccttatagtggtgggtgccttcgtacttgttgcattgttttaatttaaatgcataaaatgcttggagatatacgatgcgtcaaactcttattgcattatgttaatcatttgaatcttgttgcatcaaatgattgggtatttgcgccatgtaactccattagctctaatactaccacaaaatcgaaattggcagtgcaaaactatttcaactcacgaatatccacaaagaaaacccacaacgatcgaatacacaatggatatctctgatagatattcgtgggtaaacatgtatgggtattgggttgaggtaaaggttcgaggaatagtgaagcctgtccaaggtgacattaaaggcgatgttatcaggggagatgagatttgagtactgaattagacatatagaggtgggtttcaaaaagagacctaaattaggaaaacacacatattatgctcttataataataacaaatattattagataattaaatatataattgacacaatacaaataaattttacaaaaattcagagtagtattcaaccaataataagagaaaataataatattattatcttatttgtaaaaatcaaagataaaattaaaagatttacaaaaattcatactatctctccgctattttagc

SEQ ID NO: 6024 - DNA, 1047 bp, Glycine max
  Soy_ogl_6531 Gm19:43466575..43467621 Cluster 26
ttacagaaaaggtcaccgaattggtcgaaagacaagttatgaaaactaattctatgatcctacattttgtagcaaattaattaagaaaaatgattattagtacaaattcgtaatagcaccaaatgttttaccaccgctcactatcgttaatttgtgtcaaagactttgattacaaaattgctcatctaaactcaactaatcacatttcagcttttatttccatatagtgttcgtgcataaaactttcgtgctatatggcattgccgattaattaatggtctatggtattttgtaaaaagaataaaaatagaacacactttaattgcatgttagcatttttaggaaattttatattttctatctcaattcttggaatataacttttatatttattgaataattttatttactaacaattattttttaagatgaaatctaatatatataattcatcttgctaaatttcacctattttgacatacatttatagatgagagagtattatgaatcattagagtgcaacttaacttatatatgtatttaacaaattcacttaattttaagatatataaaatctaacaaataagtatattctagcttgggtgtaatttgcctgtgagacagacacttctttatatatgagtaagtaaaagtgtcacgtaaacttacaccactattatgaaaatgattgaatttgatacatgtacaccatatgccgattgagtggagcgtagattccctacccccactatttttgcttcccacgtttacagcgcccttccccactcccacaccacaatgccaacagatccactaactccattgctacacgcccactagatcatcctggccatacatggcaaatgggagagaaaaaaaaaggaaaatgtatatagaatcaatccgaatattaagtaaagtcaagaggatttgactcaattcattaatggtcatataaaaatctgattgtttatttgtatatttgtaacttgtattgatattcttcttactaactactaattaacatccctttaaattaaattaagt

SEQ ID NO: 6025 - DNA, 1008 bp, Glycine max
  Soy_ogl_4977 Gm15:10775293..10776300 Cluster 26
agaatgctaatattcgtcaactatcctagttgatgtgcattaacattcaatattaaaaaatttagactaaaaaatcattgactcttttttttgaattaaataataaaatacaaaaacatccttaaattaaattttagaaaacaatttttttttttttggatttttagtccaaatgctaatgcgtgcatacactcacaaaaaacatccatctcttcacttgcaataaggatacattattaatttaatatcaatgttttaaaaaccataaaaaggatcataaaagtgctcacgactcacttctctcttctctttttctttcttctctcatgttggtaataatcatcgttcataattcaaactctgaaaattcaagtcttttacaggctaacccactttatccatatgaaaatccgaagcaactcaaagtgaatagcaactacaggttgtcttcgaaccaaactataccccttgtttctgcttattgtcggtacagtattatcaccttgtgtgtgtagtgaaaggtttgttcatggcatagttgaacttaaaaaggaacaaattaaggagtgctcttttagaaggacattgcaacttaagtaggaaagacattcaatggctaaaataacaaaaataattaatgctaattccatatacatataactatgtattagttagtttcattgcatcatgattgatgaattctattggtttatctgttagaataccaagctccattacaattgttgccttggctattattattcttgttcaaatgaagaaacaaatatatattcaggcctccaaaaccaaccaaaaaatgcttattaattaatctagttcctttagaaatacaacaatttgacaaagtggcaaccaacaattttgctttaaactcgaaccagcacacccgcaaccaatgaacgaccatcgacaaaaccacaatgccctctgtgaaccacaagccactgttgtctccatgacaacaccgcaccatctatcaccatcttc

SEQ ID NO: 6026 - DNA, 1000 bp, Glycine max
  Soy_ogl_974 Gm03:39584101..39585100 Cluster 26
tggataaaaaaacttgttgaaaattgatgtagtcgatctccttcttccaatgacaactaaacacgagtctctgtttcaggcagattctatttggtcatgcggataaagctaatctctcattgagctaattttggaacgtccacgtcaactatccagagccaatagctctcccgctgctcaagtggtatataacaattgtatattcattgtaggcatgcagggtgcaaattcattaatttctgcatgatattgcttttggaaatctgctatcttgaagttctgattggttggtgatgtcaaggtagacacgggtggggagttttaaatggtagggacaaatttggcaaggagctgaattattgctaaggatatttttgctgaattaatagatatgatcccttctcatgtgtgtatgtgagtgttataagtacaatgttacaatatagggcttggactttttttgtttagttgggttgcaaaatgtaaatagggataacatagaaacattaagaatcctgaaaattatatttgatgaaaatgaataacatttatttagttaattattaaaatcttaagataaattttttaaaaatcaaataattacataatatttttattatactaaataatttaataaagagtaagaagatagtttaataaagaataaaatgatatttttatcaatttttaaggacaaattcctgcaacatacaaacactatatagataatgaatgtgcaacaactttttttcgttcattgttttttgctggtccatttaaagctggcttaattaggtatgaatgcgaaatccacctgatggtggtgcaggagcgtttggaagcgacccaaaaagaagcttgtattccctcgatcactgacgatgtaataataatgaccagcaagctactctggactcaggagaagcaacaaaaatggtgagcatgataagcagaagctgcagaactgtgaagaggaaccttatgtaagagaaagccatgt

SEQ ID NO: 6027 - DNA, 1000 bp, Glycine max
  Soy_ogl_4940 Gm15:9241601..9242600 Cluster 26
tacaaaatatattttctttaaaacgaagcatgaaaaaagtctctataggccagcacctttgaatctttagctataactcatgcagctagaaatgaggagaagggaatccagtttgttctcagtcgaaagggtgtctctttgttctattctgcaaccgagcgaagagacccagttaagctaaatgggaatgtgaggtatcttcctttcgttagggcagcacctggtttgttgcaagtccacatcggtgaatataacaaaaacttaatagaatatatagcccaagcaacgataaaagcatgtcccttcggggacatctgataaaattggaacgatacagagaagattagcatggcccctgcgcaaggatgacacgcacaaatcgagaaatggtccaatttttttttttcccatattccttctttcaatattttcaggcatgggtctggttaagattgctagcctcaaattgaaagccttctttgtctaacagcaattaaggatagacaataaatccttttctgcagcaaaatgtagaatgcgaatacataaattttttttcttgttttagccatacgagtaagcatgaaaagaaggacatgccctttgggctgagttttcagccctcaattagagtccaaactttggttttattgaacatgttttgtgggattttctctgcaaaggtagttgagatatctctgtagtaagtgttcactttgaaaacatatttattcgtttatgtgtctcttcttttgtccatttcatgtaatcgtaaaagaaaaaaaaaagaaaaatctcatcacccattaattaaacaatttcctattgcctatttgatgttttctgcccaattttgaattctcaaaacacagtaattgtatgttctacatatgataggaagttggataatttcattttagtgaatttcaatgatgaaaactgaaaagaacttcataaacaagaaaggaacatgaaagaatagaaaaatagaataaaatgc

SEQ ID NO: 6028 - DNA, 1089 bp, Glycine max
  Soy_ogl_6300 Gm18:60226951..60228039 Cluster 26
cgaataatacctcaagataagtacattacgtgttcatcatacatgctgtatatagtctctcatttggatgcaacaatgtccaacaatttcaaaagtttaggtttataagaaaaattgtgttgagcaaatatcatatcatgaagctacaattctccttattgtgtgggctttgtttgctctcttcagccacacttgtggtgcaattcttatcatatttgtaattttttttattagaattgctacgcacgcttcttatcattcatacgcgcgaattttaaaaaagaatatgcaatacaatatatatttaagtaaactgaatcgtgatctatgtatttgatcaatcatattaatgtttcttttataatgttgcaacacaacagggaatatccggttttgccccaaagatatgacgttggatacatgggctatgtccagtggggagttcaggaagaacctgctttcaagaattccttgcaaaattgcacttgtaaaaacgacgaccgttccaagaataaacgcacatgtacttgtgatgttgtttataaaacatgagataattttgcattagagtgtagtccaaattaaattaatgataaaataataagtgtggactcgatcttatatttttacttattgagaattttaaaaagccattatgtaaactcgatgttcgagttattatttttaattttttttaatgtcctttaaaaaattgatgtttggttcaaatggccatgcatatgcttatgtttgcgtaaacatcggaaagaggtgtaatgtacgcttatgaaaagtaactctttctttagcttttagtaataacaaaacggactaacttgaccggaccctctattgacctgcaataaacaagcgaaacaatcaaacggttgacccgcatgaagaaactagataaaataagttcaatttctgttcttatttaaacaggttttttaaataagtccagtgtgatattcatcaatgaaaactactaaattaatgtacaccccattttgaggtagattgtggtggaaagaaaaaaaaaaaagaaacaaagtgatagatgagtgatgtaacgaagaaaagaaaaag

SEQ ID NO: 6029 - DNA, 1003 bp, Glycine max
  Soy_ogl_1167 Gm04:1833205..1834207 Cluster 26
gaaaacaaaactagtcatttcttgtgcaagaaggatttattctgcaggtctgaagacgcaattctagcccatcattacctactttaatttactggcatgtgtgtcaatcatgcaagcgtgattattcaatatttgctgcaacaacattagatatattatgttattttcgtttattttgggctaaaactctgctcaagaaaaaaatgtgaaaatcattctcaaggcagattggcgggtcttccttttgctgttttttacataattgtttgtgatacaatgttgttgacaattgttgggatttttttaaatgtcaaattgttgtaccttcaaagagaaaaaaaaaatccatgctcatgggaccagccaatttaatctcttgagctgatttttttattccgattatttaattgttcacaacatataacaaatgatcaaatatgaatagatatacataaattaggattccaaggggataacttgcatagaaggaaaacaagacaagcgaagtaggttgcaaattgcattgtctttttttgtggtgccatgacattgccaccctccttacctaccatttattcaggtccgtgttgaaactgaatcaaaagagacagaaatgggcatgggcctgggcccaattatactaaataaggaattattatggaaccctatccttctaaaaagcttaaaagtaagatataaatgcaataagggaaatacttaatgctactaacaaatactgcaatattttgacgaaaagagttttcataacaatcgcataaatttcgtcaaattcattttaatttaaatttatccaatcaaatgtaaacaaatcatttcgtgcttatttcgtacttaatatgatcgtactgtttagcattgttcatgcaataaataggtcttgaagttggatgcataatgttgggataagtggtggcacgaatgactacgtgaccacgccgatgacgaaagcaaccaagccaatagtgtacactgcacaaacact

SEQ ID NO: 6030 - DNA, 1139 bp, Glycine max
  Soy_ogl_2875 Gm08:43718062..43719200 Cluster 26
acaatttttagtctattattatttaaaatatttttctgcacaataaaaaatggaagaagttgagaaattttgagagtgagcatgagaaaaatttgagaagtttcagtcgtgtaaaaaaaaatgaagtgtacccttatttatatacaatggtaaaaaaaaatacaattattaaaaattttaatggttaaatttttttaaatgctttcagccaacgattttttttttctttctcatccaacataggcagcaacgactattctttctttctcatccaatggctatttgttaaaacaataatattaatttgccttttttttttcaattagcagaactagcgttgcttcttcaatcaacccatgcatactgataaatccgtacgttgcttgcgacgccaattgcctttcaagcacattgcttccaaggtttcaattgcttcccaagctagccatgtgggtgctctaagagaaatagccaaatcagagtcttctactttaatccaatttatatttatatgtttcttattagtcaatgagcttattaatccctagaagctttcagattatccaagtattctttctctctttcttttctttggtcaacttcttgggtcttggttattattttagactcaatttggctgtttcggtaaggttaggcaaaaggacagagggctttatgagacaggcctagcaaaagataggacaaattgacacttctttatgaccatatctctcaccatgaaatcctctctgcattattgaagatgctaatccagcaagttgcatactcaacaaagcatagcaatttggttgccagacaattgaatttttaggatttggcaactccttagctattctggaataaaactctagctagctagccttcgaagtcttgctaatatgagatactatatatcccaattcagcaatctcttccaaaattcatttaattgtgatttgagatatcacttcattagcttgatctacttgaatttctctaaaaaagtacatagtatcttaatttttgttctaatttatgaggcaataccttagaaccagacgtaacatacatatgcaaatttatacgtgtattgactgataaaatgcttcatactagctccattatggttccttacattc

SEQ ID NO: 6031 - DNA, 1121 bp, Glycine max
  Soy_ogl_1564 Gm05:2983880..2985000 Cluster 26
aatgccctcatcggatagtaataccatcggggctacaatctgtagtagctcaaaattcttgccttcaaaaggatttttattaactctttcttaagtactatttttaaaactgttttgtgaggtcaaagtaagtagaacttcatttgtcagctagagattgattggtgacaggttatcttgctgccactcttgaatcgttgccagacagtgattgaatccagaagcttcgtaccgggtgaaattggattgttaagacttcattcctgtcgtttttaggcggcacactgttgattctccaaaggttaaacgaaagcttcttttcctacacacatataacgaggctggggtttctggttgcttgttgatctcatcatgtgtttagttgggagagtccaactgcccacatggcttattctgagttagttgatgatttctaactagcaaatctgaaccatttttatgtgaggggcaaaagggaaagagcttaagtaagaattgcagaccataccaatgactgactgatactgttccttatagcacaccatgacttatgaatcttgaaaatcaattcatttaagaaatgcgtcaaaatttgtagatcaggctttattcatttgttagctggttcactcatcgacactactccatgatggaaggccatcttcctgttgttaatttctgttttaacaagttcacttgttctcatagtgacacccaagtatgcaaactctcttcaatgtcctcctgtttatcctgatacaatttttttggactaattttgattttttataacgccagcctttctctatgatgctgtgttttttagtaacgggtggttggttgagtgagatgttggattctcttttaagtaaggtttagcgttagatattgtatatggaacagaaaagaaaaagaaaaaaaagaactgattaggagaattagtcttgtcataaaatgttgatttctggaagaaaaaaaacattaaatgataatgacaagaaatctcaaaattaaatctcaaaaacaataaatgtagatttttgaaaggaaaaaaaaaacattaaatgtggatttaaggtcaacttcatattttatcttttaaaaagtttaatttgatcatt

SEQ ID NO: 6032 - DNA, 1200 bp, Glycine max
  Soy_ogl_4905 Gm15:4438001..4439200 Cluster 26
caaacatgagttgacttatagttcatggaagtttttgatttttgcaaagaaattataaattttcacatttttttacataaatccaaacaagacttttaatattttataatttttaaaattcaattcctgccatttacaagattttaaatgatttgtttttacggaaaaaaaaaagctacaacaaacaaaaccaaccatattggagttaaaaaaaaactatattaacattgccacgtgaccaaaataagtcatgtgaaacagtaaaaaggttcatgttcattagtaacaaggttggttgatcttgtttggaaggggagggggcagtgattgttggatttctcctccttccatgggtctatgtacatgaattcaggtcaagcttccgctgctggggctcttcgaaattattgtggcaatgttctgttatcttatgggcttgtggggtagctcatgctgagctttgggccatctaactgggcttccattacttagcgacgtggatttaaggagctgatgatttcatttgctttccataggctgtgagcatgcctgaaaatctgttataaaattaagtttggaataaaagttattttgtcaacggattaaaattcatgtttttgtgttcattttagttttatctattgaatctatattagaatgtgttatagtattttcaacagtaaaactgcaaactaagcttgcactatataaattctcattcgagcttatgcattggtacaaaatattacttctttcaagagattttttgtttttgtgaagctcttctttcaagagattaagagtaaggtttttgtgggtgtgcataccttgagttttattgcagttgtcaatttcggtcattctttagagagacaaattagaacttgaggttgtttcttgttttgacatatacttcttctaccgagttttattgcagtttttaatcttttcttggagttttctctttttattccatgaagtttttatttttagaaacaatacaaaaagttgtgcctactatcctctttttattactattgggtagaagatagtttttttttttgttaacagatcttgaatgtaattggttttggtttctaagggaaggtaccccttgtacctattatcctctatcttaatgaaaattcactgtttataaaaaaaatacaaaaagttgtgcaatgataaaatcaaagcaat

SEQ ID NO: 6033 - DNA, 1037 bp, Glycine max
  Soy_ogl_3673 Gm11:1317964..1319000 Cluster 26
aaacacttttaatttaacaaccataaacatttatccacgaatcacataaatgtgattatatgagtggtatttatgaaaaataattagaattctttaatttaactcaataatgctaaaaactgcagtgtagtaaacgaaaatctctgcctataatgtttttctctctataactttatataatcaagagaaaaataggtagataaaagatgaagtgtcgaaatatgatgagtaatgtcatcaaaatatatattaagaaatgcgtgtaaaataacaaaactcgtagtaaaaaaaaatattaacaacaacaatgttggaatatttctatctagactttaaactcttaatttttttaaaaaataagcatctcatatgcttaataaaaaactacaatcccatttgttagaatattttttggtaacactatttgttagaatataaaagaacataattaaaaaaaataaaatgaaattatttatttctgtaaatataaatgtatatgaaattaaccggataacatatggtaatgtggtatataaaattgataatatattttataaatatataagaaataaaataaaggcaaatgcaaattaatatcttaataaatgagtaaaattaaaaatattctttaagaaattaaaatattagtcatatattttaattatctattttaaaaaaatatttttactataattcattaatatacctcaacctagtttttaataaatttatttattaatttaattgaactaattacaagttccataaaaatattatacggtactacaaaggtgggactggcgtggcaatagtgaatattgattgagctggacgagacgtgtgacgcggggaccaaatgattctgttggctgttgcacacacttgcacaaaacgaacgaggcccaaaaccgttggattgattacgtgtaaggctgcgattgagcctgtagagtgacgcagaataacatggaatatctctgtatttttgtgattctagattgtgaatccatatttggcattttacggttcttgtgttt

SEQ ID NO: 6034 - DNA, 1226 bp, Glycine max
  Soy_ogl_6276 Gm18:59440074..59441299 Cluster 26
taaaagctctctaaaaataacttaaatattttttagtatctcaaaattagatgaagtttaatttacatcgaattaaaaaaatgatttgtgatgtccacaatttgaaaatagtccattttttattcctaattagtgattatatgagttatctctaaattaaaccaactaattaagaatgtctataatacaagattgtttaaatagattattatttctacaccttaaaatactacatgaatttaagaactttacataaaatatcacttcaatattaagattattaaaataagtttttaacttattttttcttgcattcctcttatactagacctaaaaattacctttttttattgatataaaaacaataaaacgacattatttaacgtcactagcataaaaagcacctcctcaaatgctttagtgacaattttggtaaacaacacgtttaatatctaagtaatttatataagcaacagtgttgtagatgatttataaagtttgtccaaatttgaggtacttaatatacactgtccaaatttcagtaagaaaggtatttacaattagtatttgatcgaacttggaataggattatttccagaaaaaaagagatatatggaaaaaatattcaaaccaaaaagaaaattttctctaccaaaggttcattaatataaattccaaaataaaaaatggaaataataattaagttgtagagcatacttagtgtatttgaatttaaattaaaaatgtagtgcacacagttctatacaaatctaacagataaaagtgagttgaaagtaaaaataaaaataataatgttttggtaaatatatatttgccttaaaaataagtttgtaacttctattcaaatacacacataccaacttaccaagtgggaaaaaaaagaagagagattgtacagaaaagaagggcagcaaagcaagggtgggagggagagaagctgaggcaccccacaattcccaaccaaaccaaccataatgacatatatgtttcactttctcactgattttaaatggcaagttgtgtgacagaaaaatgaggtaccgaaacgtggaccgtacgtatagaacagaatgattgagatcggacggcggaggagagttgtgggacagataaggaatctccggacaacacggcagcagatcatattgaggattatcagcggatcccggtggtggggccaccacagaggagagccaacttgcacc

SEQ ID NO: 6035 - DNA, 1300 bp, Glycine max
  Soy_ogl_363 Gm02:3862501..3863800 Cluster 26
gagttgtgactttggccaagtatctatgctcacgattttgtaatggtttatggtatgttgaaataaggtgcttgaggagaacatgcatgcaatctttgactaaatacctttggttgttgataaattctgtatcaattgtgtttccattttcaattccaaactgaattcttcttacgtgcaataattcatgaactgttaaaggtatggggctgagcaatctgccctgttcaaggtataagatagtctgaggtagggggaaatttcctttattctcataaattttcaagggcctatgattgtgtatatgattcatatatcttataaaaaccggcgattgtttgtgattgaagagggtgaatgatttggattgaaacggggtcagaatagaaaaaaagatgttgcatgttattgttctatttacacctagcaaaatcgttcttgcatgtgggattaaaggggtcagtcaatgtccaaagttaaaaaaaagttgattgatgtgtattcttatgccttgatatgtttttttaaggttaaacatctttttcggataatacattttttgatgtgtattctcatgccttgatctgttgggtttttgagaaaaattgtcttttatggtttagtttgaatttccacttggagatataaggttggttagattgttaagaaataagaaataagggaatgaaagaaaaagcatggtttgatttcttgtgttaaaaaaattaataaattaataattaatatttaccgataaaaaaaaggtgttgtatctttttaaatgttgtaaaattttaaaaaaggaacattgaaccagtttgaagagctagtgttatttaccttttatgacaatcttaaattttgttagcaccttcataggtcttccgaaaacacccatgtcctattaacgtactcgaagatagtcaaggttgtagattagggtgatgtctatagagtcgccacacttacgcgtccattcatgcaattataaaccggaatacaaagtcgtcaagtgtgggtttggttacgacgatgagagagtgacacttacaaggtggtggtggtccttttcgatattaaatcacagtatcgggagctgagagttcactgtttggaacaacaagtttatggacagtttgtgagtgacactcttaactggttagcacttcccaccccgtcgagttatgattatcaatagaaaacttttagtgtcaatcagttggtagcttttcgtatgacctgaagagagagagacatacagatacttgtcaatgcctgatggtctctctaaagtttcttt

SEQ ID NO: 6036 - DNA, 1122 bp, Glycine max
  Soy_ogl_366 Gm02:3961872..3962993 Cluster 26
aattaacttttaaaaggaatatttattttctcacaaaattactcataataagtaatttattcatttacaatcaattaatcatgtagtagaagcaaatataatttgtctctcatccatgtaaaaacgtgacttttaggactactagagtccaacatttaactttttatgtgtagcatgaaatattaattttcaaaatgatttgtaatcatatttatttatttacaaaaacaatagcatttcatatttaaaataatttcaaagtgacttttttttaattccactttttatctatatatttaacacttgagaagaattaacggctcatcacatccacctcccatctttttcacacatgcgcgcgcccattataaggcctaacttcaacatgtttctaattcatttccagcaccactttttattccaacagccaaattatattaatagaaagatgaaaaggattatatttttttatcaataaatattacttgttatttttttacttttcattagataaatggatcaaactctgatatttttttttccttttttcttttttccttcaactgctcttatatctgcatacgaaagaattacacgagtcaggtaagatgtcacatgaagttccatccaccctcaatacatatgacagagtatattaaaacaagataaccactacatcagattcctttcaccccatttactttccccaatgaggattagccatcttacatgatacccttatacctgtaacaccaccatgcacttgtgacagacccgtagggtgtgtaaaaaaaaatggattcagatggaactggattataatcgcttaaatcgaatggtttttatcatcggatccaattttcaggcatatataaagcgagtaattgaatcccttcattttggccttccaccagcagcaccaaaaatattgcagcttccctaccactgcctccatatcccgattagcctagcctagctcttcaaatataattgcgtttcggtattttcaaatagcccaccaaaccaacttcgccttcttccctattatatttccctcatgctgcaagaagtgtccttgagtatcccttggttcacatggtcgatctaccatttgggctcaat

SEQ ID NO: 6037 - DNA, 1516 bp, Glycine max
  Soy_ogl_1078 Gm03:44018485..44020000 Cluster 26
tacaactaaaaagggtcagcacaaaaataacaaatagtcatttgcgaaagcgaaattatatatgactggagaaacaataaaagtaagaattttttttggtgaattacaataaaagtaagaataactccttatacctgaattcgattcaagttcttacctttaaaaaaataataagatcaagaatgaggtaaaaaattcatttccattttacatgccatattcaatcttattcatgcataatgtttttgcactgtttaacttttgtcatatagatattactcctcttgttgaattattaattttcttctagaattgattcaaatgggcatatatttcttttatataatgataataaagtttatctaaatcactatcattgattaactctagtagattcaaatgtatacacatacaattagcgcttatgcaaagtagtgacagatctaggatggtttaatttgaagtaacttcattttgtgcctcagaattttacaaaatttgccaagcaaatctatttattacttgaagtttttttagcacaaatacagtgtgtctatgtaaatgcagaacgaaactcacaatgaattttgttaattaattatatctatagacgccggcctgtcataatccaataaactattttaaggaattatgtgttgaaaagaaaagttgaagccagcagatacttaattggaaaaaaaaaataggggctggaaacccaaagaaaacgtttggtaaacgataattgcctttcccattgatacccaactgtttgaaattgaaacatcgcagacaggaaaaaaagaataatggaaagatggaaagggaaatctaaatttgattgaaatgagagatacaaagtcagaaccgccggttctgcgaactaattgaatattttttaacaaatgctcatcaaactctaatcatagttaagtaaatctatgcagaaaaattaggactgcatgcatacatgttggagcaaatactactactattagacataaagtgaatgataagagctaaaatatagcgtagacttgacttgagtattttattttgttttgtttataaggggcgccaattgttatgtcaatatgtgcagctaggtcacgactcactcaccaggaaagttagcaagttagatccgaagaggttatacacttttgacctagttgagttctaacgcgtaaactctgctatggacacttgtatatagctatttggtgggccatctttgaggcggtgaatggcccacacgtttctcagattctgccaaatttggcaagctgggatcaatgaacaatgagtcagagaagaagactccaaagtcgagcggttaaggcttcactacatgcttgtttgaataaatagacaccccctgctcctgttgtaacctttgcctttcaaattaataatgcaacgcggaaactaaataagttatttaattataaaatattgcatgcagaataatcctcatgtacacattgattttgataactctatttccattgtgcat

SEQ ID NO: 6038 - DNA, 1300 bp, Glycine max
  Soy_ogl_2114 Gm07:1381701..1383000 Cluster 26
taattttcttacaaaaatgtctttaattatgagtcattttttaaattcattaaatagcatatggaatatatattatttgtcttggacatcttgagagtttaattgcgtgtgaagaagagattaagaaaatggaagttaagaataagagtacatctcattaatgtttggggtgatttaaaaatgaaattagtgtaagcagtaaacataagttccttttcctgttccgttaaattagtactacttgattatgagggaccaattttcttttcgttcttaggggtccatagtgaaaccaattaaaagcacacgattaatgaacataaattctactcaggctcaggcccactaagcttcacctggtcccgtggtactacttatgatttgtgctccttgtttaccgctgtcacatttgtttcaaagataagatcaaagttgaagcatgtccacttatgattgccgaatttcaattcagaatttgaataacattactccaatgtgagcaatatgaacatggccatgattcatgaaccccccaacacttcatacacgttattgccaagtgccaaccgtcacgtcccccgtaaacaacactaggccatgcgtgtactttcctctacaatggtacatttggttataacaatcaattgttgcattttagtgtctgagaaatcaattaagaagaacgcaaatatggcatccctttttagcatcctctgcacggcttcgatcgttgtcttcttggctgtcaaatttgctgcggctagggaattcaaaatgggtggtgatttgggttggcatgaacatgccccaacgtcactgcattttataatcattgggatgcaaggaacaggttccaagttggtgactctttggttaagagtaagactagttacatcactcatttatttattgtatgggaatacaacttttcttagtcaccttttgcggtataatttatatatcattttttttcttttgaacagaaaataaaataagacaaaacttaaatacaacttgttagatttcaattagaattggagtttcaatctgataatccacataataaagatttgcattaaaggtgaacataaattattaaggtaaaactccatattagagatcaacaccaaattaaaaagcacaagttttgtacaaaaaaaattgcaactaatatgtgccatttgtttcaaatagtaaggtgatcccattatataaaaacacgttaattgaagtttttgtctgtgcagtttttgtgtaccagaatgactcagttatgagtgtgtagaaatggaactacttt

SEQ ID NO: 6039 - DNA, 1300 bp, Glycine max
  Soy_ogl_2634 Gm08:12422701..12424000 Cluster 26
tttcaaggcttgattaaggtggtcaagcttgtgaaacacatcaaaactattttagccaagagataaatggatgcaaatcaagatagagcaaaaaaaaaaaaattgaatgcaagttaaaaatgaaattataatttatccaaggaaattgaaaagcaagcgaggaaattaatttcaattagaatatttggatagagaaagaatgtatagttcaacccatccaaggatattcaaagataaaatcagaaatgatccaataagatatttaaaagaaaaatcaaaatcaaaatttaatcttatcacaataatatgtggtttatttaaaatttaaaatctttctattatctcctgaggattttcctttttaaaatttttgttatttatattgattctgttgttgagttgtgtgcactgggtagaagaagatgaagagagaggtgactcaccctcagaccctccctgacgaattgatccatgaaattctattgcgtttcaaaagtgtgcataaatcatggctttctctcatatctgaacccgggtttgctaaatcccactttgatctagccgcggcacccaccaccgacttcttctcaagtgcttcaatattgatcctgaagttgataattcttatgttgatatggtctctaacattccacttccattatctgctatgggaagcatgcatggtaaatatttatactattaaccaattctgccatgggaatacagaacacggacaacaatgatttctttgattttgtcataaccggtcagcgtatacaaagacaaactaatcatgtgtgtatccatcctcaaatgtccggcattgggaatgattcattagctgatgactacgtcgtggcgattctacaattgtcactagatcaagatttgccgtcatatcccaaggtcgattttttttcttcgagaaccaattcatggagtcgcatcgagggaacccttccttgttatttttcagggcaaaaaaatgtcaggcataagttcgtgcacaagttcatgcacatgttcttgaatggagctcttcattggatgattgaatcttataatgatcttggtctaattattgagtttgatgtgagggaaaggagattatcagatattccactgtcacgctatttaaccattgaatgggaatataaattacatcatttgactgtgatggaaggacttgtgtgtttgtgtctctctgactatatggatgatctcggcactactgaaatatggacgatgaaagaatacaaagtacaagaatcttggaccaagttatttgttcttcctaata

SEQ ID NO: 6040 - DNA, 1032 bp, Glycine max
  Soy_ogl_6940 Gm20:42592969..42594000 Cluster 26
aaagctattataaaaataagctatttctttatattattgagataaaagctatttgttatgtgtaaatgaaaaggctattataagagaggtccactagtacatagggggtgacaaactagaccgatccactccaccttgacgttgacctgcaaaaaacgggttaaaatggattgacggattcaaaatcttaatataatcgacaaaaaataagagggttaggagattagttcatcggattggacccgttttatcaccctaatataatttttttgttgttgttgtttagatcatagattaatttattagatataatcttattcgtgtaggatatgaacactttcagcaacaaaggttcaccataactttgaattctattctaaacaacctttaattaaaatatcactacaactttcaattcaaataaactataatccaagaaattatctacctcaaattaacttagtaaaagaggccacacatgtatgttgataaaaatgtcatacatttttataaaaatgcttaatatataactctctcgtttaaagtaaaaaaaatattaaaatttacttcagaactcaatcagcgttggactcaccctaggttaatgcatatatctgaacaatccgactgaaacacaatataggtagctatacagtccccggatgcatgatatgtgacttaacgtacaagatttattattaatcataattgaaaggacatttttattgaagttacttgttagcattgttttttcttcaaattcatatgtatataattttatttaaattttaaaaataacggtgtatctagatatttctgcctgtaatcaacttaacacaagggaaagattattgaatgaaatcagaaaactagttgcaccgagatgaggaaagcaaattgtgatgacatcttcaagaagatcgatcaattgaagtctcaagacgatacacaatgtgttgagaataagttaggccgttaggggcaataatatgggctgaattcatactgcaatcattcaaaagtacaacaatg

SEQ ID NO: 6041 - DNA, 1344 bp, Glycine max
  Soy_ogl_187 Gm01:47709757..47711100 Cluster 26
ttgtagatagtcaaagccatatctcctagtcaatttctaccgaagcatgctcaatattttaatcaatcaaatgggaaataaaagtttgctttactgtatcatcagttggaacttattcaagcgattgatgaccaatcagtgcatggtggagtggaaaacacgtgcaattctacacctgaacttacattgactcatcatgtctttatgttgcacaggcaggtgcaactattatgtccttttccttcacagtaaagtagggcacacacaacacaagatatgcaaatacaaaatattaattcagaacttagcagttagcacgtacctttgcgaatcaatcaaattgctgtaacatacgaatttgcagctagcaactccgttttcttttctttaaagggtttggtatacatggacagttttacatcttgtctctgtaaagaggaccaacatgaaaaagaaagtggtttattgaacattttcctctttgtagatcagaagagaatagttcagccacatttttatctttttcttgtgaccctttttttcttttctaatttttcatcctttacagaaaatcctatcctgatatgtagaatcaaaataagctactaacaaatgtgtggattaactagcgtaaagttatttaaatttaaataaatatacaacaatattaaatattctaataaagatatttatgtttataataatctcacttcctcaaataaaattgtgtcaattgaagaattgatgtgttctctaccctagaagaatcaagacaagctgaatattcagattgcccctatttaatttaattgcgtccttacctccaccacaaaacaaatcaacaaatgcatttgtcctctgcatctaatcaaacctctttcctttctttccctatcatcaaatcatgaaaactcgaatcatgctataggctaatatattctcctccttttataaaatcaatctacaaacttctaatgatattaaaacctatcatatcttaataagactctttattccttaatcattacaggggttactttaagaataaggcaaatcctcccaacttggcccttgctttcatgtactactttataggaggccacatagataagactacacataagacctaggaatccacattttggcaaaaccccaagattctttggtttgaatttgcatcatcatgcatatgaaaactgagttagaaagaagttgcatactgcagctagctgcttgagcatgtatacatgtataaataagacgcgtacgggttaggtttaaagcttcaataaacagtatttgcacgagacagcgcacttgtgtctcttcttttaacaaatggta

SEQ ID NO: 6042 - DNA, 1100 bp, Glycine max
  Soy_ogl_325 Gm02:2460001..2461100 Cluster 26
gaattaaaagaatcattacataacaaatgtccccgatattaaagggttaattactggttgtagtccttaagccaatctggtttatgagtctctcgttcgatgatgtagcctgactatcaactcctttatgttattttgagaaagtagtggttaataacaaattttatacgtcccagaaactgtcaatctatatattaaatattaagattaatattggtacaccatacctggtgatatttagtacgaaactcacgaattaatctatacatgcatatattgatatcatttactaaaatacatataaattaagaaatatataaagtatatgatttgaaggaatacttcaatgtttattacagtaaatgatatcaattagcaaatgcatttgtgagtttcgaatgtgaatatatattattctttgcagaaagaagcttacagcatttcatgcaaatattaatttgtactataaataacatccctcttcttataagacttttatccagcataagggtgcataataaacttagacaaacaatatatgcatagtcttttgctaacggattaaaacccaattaatgtaacatgattatatcagaacttaacattcaacaatcttttcttatatatacagaggaggatcaaaggctactaaaaaaacgacacaactaaaacgaaaagagaatgacacgttgccgttgaagttaatgtcggggacaccgcatcggagtaacgagagtcgctgaatggtctcgttgtttaggttgccggtgggttgcagtttgaaatattgctggtaggtcttgatggctgttattgtttcctcgtcaagagaaacgttgaatggcgtagaggattgaaggtaaccgaaatcagaaaagtactctttgatgagagataggcctttgatttgtttcggtggtgcgttaatttggatgtaattgtaggggaaacttttgttcgatattgtccatgtgattctcccatattccttgcttgaacgccttgcccccttttgcccttctcactttggcagtggaagaaggatggaaacggaaattcgccaaaagggattggtcgacaaggagaaggaatgcataagg

SEQ ID NO: 6043 - DNA, 1000 bp, Glycine max
  Soy_ogl_3188 Gm09:39190301..39191300 Cluster 26
aatgaataaccatacatatataagtggttagagtgaaaattgagaaagcaatggacatttcagttctcttattcataagtttttttgtaacaatctttggtacaattcagcatgttaatttgctatacgaaataaccatagttaagcaaagtggctaattaattgactagctggagaataagcactacaaagacccttattattataactggcaccccttaatactctaaccatttcttaattaccacgccactctcacgtaagtaacaacgaaagacaacttgtcagttattgcatggcgaaacgtgcgcaaggcaatgatatcgttctctcccaagtgctgttggttgcagaaactgagccaccctcggtttagcacatagtaactgatggaacctttgtgaaatttcttgagcatcatctcgaactcatggccatgtttgtcatacacgttcactggaattccgtctctaacatcctcaccttctttcaagaaccctaagaagataccttcaaactgaggcgtgcgcaagaacaggttccacttgtcgctggtcagttgagtgatatacggcatgctcagctcgcaatctttcacgatgccaacgttgagcaggaacttcagctgcgactcgttgtaagataggatttcgtttaccaatctgttgttgttgccttcttcactttttccactttcttcatgttgttgttcatcaataatgttctttcccttccctgaatttgatgatgagttctctgtcattgctttgaggaacaaaaatctttggtgtggttccttggagcaatgtgtaggttataatggaaaattggcaaaatatatataggtaagtaccacacacaaaccctcactcgtgtcactctcactttcattggctcaatctcgtcatttgtattttgacccaccggatataatttccttattgggttagaatatttagaaacacatgtttaaacatttaatgtttactcaaacttaaat

SEQ ID NO: 6044 - DNA, 1161 bp, Glycine max
  Soy_ogl_5329 Gm16:5756740..5757900 Cluster 26
acttgaaaacatgacaaatgtcttttgggggtagactagttattctaaagtttgttttaagtaacctcccactatatttcttctcattttacaaggctccaaagaatgtgataaaaaaaccgattaacctgcaacgaaatttcctctggacaggtgaaacacaaccaaagaaaatctcctgggtagcctgggatcaaatctgcaagccaaagcatgaaggtgggtcgggggtgaagtgtttagagatgttcagccttagtctactctcgaagtggagatggaggttgctgaatgataagtctgcaatatggtgtggttcgctgaaatccaagtatggacaatttaatgatttaccatatgaaaatctacattcttcatctttgtctttatggtggcgtgatatcatgaatttggatgctaagatatcaatacaacaagggtggttttataataatgtaaggcttagagtggagaatgtggtgacaactaggttttggacgcatagatggttaggggaaaacaccatgaaggattttttcccccacttgttttccatctcaaaggataaggagaggttgattgcagatatgaggagttgggaggcttggcactggaggtggtcatggcgatggagaagggctttgttcgtgtggaaggaggagttattatcacacatggaggtgttggtgaaggactttgtgactagagagaatatggaagatacttgggtctggttagatgatgtagatacatttccagttgcatcaacatacaaaaagctggaaatgatatattatgggggtccacaacaacaacaacaacaagcatcttggtataagcttttttggtcctataaaattccttccaaagttttgactttctcatggaggcttcttcaacaaagaatctcaacacgggatcaattacaaagaaggggtttgaacattaatatagataattcttgtgtcttttgcaatgaagctatggaagactgtcatcatttgttttcatcttgcagagtcatggatgacatttagcaagaggtgtattggtggatgggagtttcggtggaaccaatacagtggattctgcaacattatgaatttataagaacctgctggagtggaaggaaggtgaaacctgttaaatctatcttatggc

SEQ ID NO: 6045 - DNA, 1200 bp, Glycine max
  Soy_ogl_5867 Gm18:12401..1507600 Cluster 26
gtgtgaaggtgtgcaaagggactcccctcccccctctcacttattattgctaatgattgttttcttttttgtcggcctaaaaataatgaaattttcaccctttaggagatcctagacacttatggaaaagtatcaagacaacttatcaattttcaaaagtctgaaatctttttgagttcgattattcaacaacaacaaagacacaaaatctcttcctaggtgtcactaaaagcattggatccaacaaatatttaggacttccttcaatcattggcaagagggaaaagctatttttgggttcatcaaagatcgtctttggaattggctcaatcattggactagtaaacaactctcaaaagcgggtaaagaaatcctatcaaatatgctgctcaatctatacccttttgctgcatgagtgcttttttgctccattccactttaaaagatgattttgaagaaaatgatgaagtgtttttggtggggcaataacaacaaaggaaatgaatcaattggctcagttggataaaattattataaaaaaagaatttggaggaatgaaattaagacacttgtacgcctttaatcttaccatgttaggaaagcaaggttgaaaattcactaccaaccaagatactataatgttcaaaatcttcaacgctaaatatttttcatcaatggatttcttggatgtccaccttgggcacaatcccatttttgtatgatttagtattcacgcttcacaggtaatggtaaagcaaggtgttattggaggattggcaatggtgattctactcatgtctggactcaaccttggctctaacaataatcttaatccttttgtctcaaccaccccaataatggtatctctcctcttaaagtttctgaccttattgatcatgctaattgcctttgaaggaatgatattctagattcaaacttcaaccaagaggatgctcaaaaaattcgttccctaacactattgaatatcacggagagagatcaactaagccggaaatattcaacgaatggtgagtacactgttaagagcgcatatcatgccattatggatcatttgctagacaatagccacctcaaggttaaagggaattggaagaccatttggaatcttgttgtgcctcaaagaataaagcacttcacttgaaggcttcttcgaaaatgcattccaacaagatccaacct

SEQ ID NO: 6046 - DNA, 1250 bp, Glycine max
  Soy_ogl_6263 Gm18:58979338..58980587 Cluster 26
ataagggtggaacacttggtccttcatccaaaatttgaactggttgtcacaaattactttgcatcatttcctgaatcatgatggccagcttctccatacagaaaacaaacaggtatggagacaaagggtcaccttgtcgaaggcccctgttaggatagaggcatcaagaatctcactgttccacttcaaggacaaggaagtcgctctcgtgatttctggaaccaaaggacttcctcttgagctaataatacttcattgtacttattctgtagctccttctcaagtgaaaccaagtttaatttgcccacttctgagtctctaattccttatgaactcctttaattcgccaaagatttcagagttgaaaagaagagagtcttccttaacatggtgcagctttatcagaatattggggttaggcttctcccaagctgaggcaacaacattctgatactcagggtgggaaaaccatgcagcttgaaagtgaaatagttctattttcttactacacgatttacaacaactgagtaagatgggattgtggcctgagttgtgagatggtagtaattttgcagcttggattttgtttccgtgtgagggaagggaacctctctatcaggtatgatagatggtcctcttaaggcgtccttggttgactatgttcatatccaagagagtcatctatgtcttagagactccgttgaataatgatgtaaggagcattatttacaacactttttttggctttcaaattttaattgtttacccactaatctgtttctttttcagcgccattcgtattcaatttgggttacatgatgaatcagtgttgcatgttttcaaggattgcaacttgtccactcatgtttgaaaccactttcagtttgactttctagatgctgatcaaactacatctgattggcttaaggaacagcctacgagtgacaaagttcagatgtttgatacaatggtcatcgtctgttgatgtgcggatcgaactcttacagtgcccttaatctggtcaccgaaggagtaaatttggctcatcctcatgcccctattgtccaaccaattcagtctcttcttgctcaagattggaatgttactctccatcatacattgcagctaacataggctcattggaggacattcctctcgccactctttcggactgcacttatggcttagcacaattgttgtacgttgatgccataggcacgttgttttttcgaggctcttagcacaactgt

SEQ ID NO: 6047 - DNA, 1000 bp, Glycine max
  Soy_ogl_6642 Gm19:50135701..50136700 Cluster 26
tgattattatcaatgaaataagttttaccccattctttaatctttatatggtataagcttagcctgcgcttaacagttttaggaccagaagtcccaccattgataatcacagctggttggttgacctaagatatcatcggattctaacacaccccaatcttctgatgatgtcaaagaaccatcaacatgttcaacaaagttcagctgggcaggttcatcttccatttcaaagtattgttctgcttttatgctgcggtcacattcccagagaacaccaacaatgtgttgtgatctttctattgacgtgtttgactgctttacctcttgttcacttttcatagttgtcgtttcactctccgtgctgtttgctgctttgtatcctgtagtacaactttgagcttgttctagtggcttttgtattctatcatccagttcttgcaactgtttgaaaattgaaaccataatcattagcctctaatagggaagtaataatggatttgaatagtaaacgcctctaatataatgaaatgttttatataattggataaatacgctagtccaacctagaaacttaggaacaattaattatgtgttaattgcaagtatcttattcacctgtgttggcaatgattgatgctccttgttcagagcatcaaattgttatagctggctcgaagtatggtgtagtctcgttgaagccgctttgacttccatcgagccctcttgttttggaaccatatggcaacctgtcttggttgcaacccaagctctcttgccaactgcaatttctttgtgggttcaagtcttgcgtctgcttcaaatatggattctaatgatttgatttgttcatcattcaaccttcttttatttttgcttggcatgggagttcctatcatgagtgaaatttccaattgcatttgttgctttatactccaaaactcaatgggcctggtttaacaagttagtgctcttcccacctctgccttctgaaccttacatt

SEQ ID NO: 6048 - DNA, 1100 bp, Glycine max
  Soy_ogl_6827 Gm20:38003901..38005000 Cluster 26
ttttggctctgggagtttgggttaaagagtgcctaaagacttcaaagccacataatgttctcttccaagaactgataaccacgtctccacattctgcagtaatgctccacattaaggaagaccattatttcaccattacaaaaacattccttcacccaaaccaacaaaaagcatatgatttctctgcaaccagcttaaggaaattattttgtctgtgagtcattaacgcacaaacaatttatgcacctttgaattttttacagaggccacctcccaaaatacctatatatccacccggatcccttgcccatcaccccaaatacaaagtcagaatgaaataaaaacccatcattgttgctgccacatagtgccaaatcacctcatgaaagcactgcaccaaaatgtccaaaccagaaactccactgaaaaccacaaacagcagcaaaaccataaataacgtagtcaaaactactacacaattggtcacatcaacaccacaccagacttcagaaccaaatctctgcccgactaaccgcaccttgtttgatccaaggcatgataccggaccagacaaccagttaacaagaggataaatataacctttcttcctaccttcaaccaacaccaagacatcatttctagtcttccgaattccccacatcacagcaaaccaaattgcctgaccttcatgtttcttgattccaaaactgccgagtaagccatcaaaattaaaaaaaatgcatccatacctgattatgattaacagatataactctcagccagctcataacactctaccatacctgagaaaagaaagagcagttatagaataaatgctcaatggttttcccctcttccctacaccccacacaaaaacattcctcagccctcaaaatccctctgcgatatagattatttttactggaatacgatccttcaccaccatccaaataaacataatcacatttaaaggtactagcttatgccacaagaacttccaccccccttcaagatttacaacgcagacagatctctcacacacacacacacatatatatactgatcgaacattatacaaaccacttccatctatccttggc

SEQ ID NO: 6049 - DNA, 1000 bp, Glycine max
  Soy_ogl_1074 Gm03:43741401..43742400 Cluster 26
gtatgcaattgagaaaaactattttctcgaaagggaaattgcagaaatgtgctataattgttaccaggttttcttgaagggttccattttttattttttttgggaaaggcaaagtgtagtatatattataactcaatcaaaagttatatacaagctgtacagtatacaagagtccagccatataccaaaccaaaaaagcttctgatatcaacaaaaaatgggatagataacatctacctagcaatcaagaactccctcggatcagtgcaccagaaagaatagaaaaaccctgttgtatgtcctgatttatacaggaaccacttcaatgaaacagtgttgatttgtgccaaaaagtcaaacgaataacgaatttgtctctctgtttctaaaaataattgagttcttgttggtccatatacaccagcaggtagaatgccaaaaaatgtgtttatataatctgttcatcctcccttgaaagcaattacccaactgattatacataccatgaaaatcattaggaaaaaataagagggatatccaaccaatcaaacactttcttccacgcctcagagataaccctgcatgatacaaaaaagatgttgagcgctttccctttcttctttacaaaaaacacacgaattagacatgttaatgtttgtaattccccttttaagcaactgttcacaagttggcaatctatcttgtaacagtttccctgagaaagccaacacttttgaaggaattctactcttccaaaagtttttgaatgaagacacttccaacaacagatcggacccctccctctcaatagaatgaatgaatgtctctatacgcattagccacagaaaaacatctctcaccgcccccacccacttgtgctcccagaatcttgttgacggatcgtcccctaccctccttttgcatgaatccacgaaccatcctggttggatcgagttttcagaatcaaggttcatgatatctctccaccatatagaccatc

SEQ ID NO: 6050 - DNA, 1368 bp, Glycine max
  Soy_ogl_2630 Gm08:12393101..12394468 Cluster 26
ggttagtattcaaaggcaatttttgtgggggtgtgaggaggggagggaaaaaatttcttagatagggtgggaaaaaatttgttcacctaaggaacatgaaagcttagggttcacaaacagacatatccttatttaatattgctttgcttgccaagtggacacggaaaatgtttaataatagaggcgagctttgggagagggtgttagactcaaaatacgttgcttctcaaggcttatgtgaggatgaggtgaacaatcatgagtctatttagtagagagatttaaagattgcatgtgggggacaaaataataggtggtttgaggattggattgagtggagagtaggagatggggcatacactagtttttggaaagatatatagatggattggggaagaatgcttacaaattaaattcacaaggttgttactaaattcggaacaaaaagttgagagtggatgagatggggaggtgggttgatggtagatgggtgtgagaatttaaatggagaagaaaatgatttgagtgggagaaagaattagcgaaggagttcaatactttggtcaacactgccaaagtggaaggtgtagggtgtgacacttggcttcggttgatggaaactacacataatttttcagtgaagtctacatactcttctctgcataatctgcggattgggtctcatgagaatggggtgtttaaacttatgtggcatattaaaattcgtcacaaagtgtctttcatggtatggaggttgttacatgatagactacccgcaaaggtatatctacataggaggcacatccaattgcaggaaggagctatttcatgtgtgttatgtaatgagaatgatgaagacgtatatcatgctatcttctcatgtcagaacgcacactctatttgggggagttggtatcggatgttggacatctcaacagtttctctaggctcagttattgaacatttcagtcataactcccagggtcgttatagtccaaaagctagggaaacaagatggtgttcaaaggtattattttttattaggagaagctctggcacaagatccgatttgatttgtggacatggcttatgttggacacatatcaagaagttcaagttttaaatttgaattgttaacaatttttagatttagatttgcaaatatgtttttttagttttagaattatagatacatagcatataaactttgaatggttagtttttaagattattgttaatttttgaattttacatatctgttagtttttaaaattattattagtttttgaattttgtaacttctatatagatagattagcaggtaaacttagatcaggtaattttcagctttttgaaccttgtaaatcg

SEQ ID NO: 6051 - DNA, 1294 bp, Glycine max
  Soy_ogl_1109 Gm03:45942703..45943996 Cluster 26
caacaaacaccaaggatcaacgatttggaaatgatgccacaaacgcgtgctttgaagcaataagtcgtgcgtaaatattactacacgaaaatcctcttatagaaagaaatataaataattttctcaagtgtaatgtatctgacatatttattttcggaattacacatcaggctagcacatggaataatgaactgggcaaaacagttatatttgaagatgattttttcaatattttcccagtggacattgagattaatatcataaataacaaggtttatgctaatttcggtaatggtataaatagtttgaaggctttctacaacattgaagttgcagcaatggtccacttaaaatacagtggaataggtacatttagaatgaagtatagaaatatatctactcctcaaatggcattcaagattttccattttatcaaaatatctaaagaagaacaagtcttttacattaaagaaaatgcaccttgataatcactcttcagtacgctctctctaaacactcttgattaactcccaaactcacatcctaatatatttgaaaatataataacaaacattttatgctcaagaaaactcactttgacaatcatgtccagacacctctacctatatctgtcatatcaaaccttcaacagatcaatcacccttaaatacaaagaaaaattcataagcactacttgcacatgctaatactagtaaagtaaaaaaaaaatcattaataaaaaattaataattaaaattgtgattatatatatttatatcaattattaattttgtaaaaagtttatttatgtttaaatcttaactatttcttttcttgtaatatctcaatcattactttttaaattaataattgcaattctttttcttctaaaatgaactcttactaaaacaaacagaaaaccatagttataaccgtgaacatgacagagattatataaaacaattacttacttgacgtaaaaataaataatcacttacgttttgcaaatgtatgccactaactataagaagacaatgaacagcggccaatagcactatgcagattttcagtggccaaggctgaagggacacattggagtaaactgattataaattttaattaataaatggaatgtaaatttaccaacaaagtcgatatgtccgagtggttaaggagacagacttgaaatctgttgggcttcgcccgcgcaggttcgaaccctgctgtcgacgtttttactgaaaaccacaaagattcttcttttaatttttgcactttaatcggggattgtgac

SEQ ID NO: 6052 - DNA, 1596 bp, Glycine max
  Soy_ogl_1111 Gm03:46173401..46174996 Cluster 26
aggaaagatatcttggactttgctgggtgaattctttggcccgagcttgctcaaaaaaagctgcttacgagagtctgaccgaatttgagcaagtgaagctttagcaaataaaataataattcgattttaaaaaagattccctcttttataatttaattacaagattgtataaacatgtttactctacttaattacaagattccctcttttggccaaactcttataaatgtttaatttatagatatttcttgaaactattacttgtattgagatatgtatttacatccatctgttgaataaaaatcgatgagctacatatttaatataaatgatcagaaatagtacgaagtttgttgtctaaaacatacgagaaaaacacatggtatgacaatgaacttgtcacaaatcacccagcgaccattcaaattgagcgatgtagatgatttcacactcgatggaacacttttgtttcgagggagcaagcgttgactgtcattcgagatctgtgcatgcctcatccatggactcgttccatatgcgttgacgatgtaaccattgggtttgtgtctgtgtctcctggaacaggtgatgacaggtgcagggctgagattgactatgtcatagttgccaagtactggggccaagggatttccaccaaagcagtgaagattgctgtcacaagtcttcaaggatgtgcctgatttggtaaggttacaagcttttgttgctatagagaacaaagcatcccaaagggtgttggaaaaaacaggaaggatgttgctatttttagtcttgtgttagaggatattcatcatcctccattgtaacaattaatcattggtatgaggagtggtacttttggtaattcgtgaaagccaaagtcagtctttgtttctagtctttttttcattagttgattacttgatctttgcagcatctgaaaaatgctacattctgtttctgaaaggttgcaaaatgctatagtgtggtattcttgactattaaattagttcttcttagatagaatagaacacaaattaacctggttcaggtcatattcccttaaaatattgctgttgaagttggttcacgttaagtattaaaccaatttagaactaggtgtaacagcaatacgagcagaaaactgacaaacttatttcaatatcttatcccaagctttcagatttatggtggaacttgtattcataaatttttgcttactgtcttacccttctaaattgattaatgtgccctgtctttgctctagagtataaaatgcttgattaaacaaatatttaaatacacaaggtgtgccagattgtaaagtcccacattcacattgagtgactaacataacatgtgttagctagcctgagtaataaacaatacagtgcatcttcgtgcgtgtgataatggtttaagcttgagctcacactcttgttgaggtgagttgatgcacttgtcccatttgtcgttcatcactaaataaagtaaaacacactgagcaagatcacaagaaaaggcgcataggataaagatcgagtctggagttggcccaatacaataaatggagtatgttatacatattatctccag

SEQ ID NO: 6053 - DNA, 1050 bp, Glycine max
  Soy_ogl_3665 Gm11:470051..471100 Cluster 26
aaatacaattcagcgtgcatattattaagcataagattctcgagtctactagtaatatgaaacatgcatatgatgacagtcaaggtgttttggttaggaagagaaggtgtcccaccatataattaatgattcacaacagcaaacccaaaaggaattatacttatggtgacgccgaacttgccattagtgaatactttgatttgataatggcgaaaatcacaaaattaaaaataggttgacttatgagttaagattgtgatgcattgcgaattgacaatattatgtgagaaaattatcttatgcctagtattatagtaagaacttgtcgctgtcaatagccatttacagtacaaatacatcttaatggagtaatgtaaatggtagtgaacgagtgtagtaatatgttcttgcgaaaattaaccatatcgttagattttaataaattcataacaaatatgtcgcttcaaatcgttgaatattaatatagtactatgggagattgtagtttttagagggaataatttgtcactcgaatattccatatattaatataaatagatcaaattgcttttctgtcggttgaatttaactgattcaataaattacattggaaattggataacatatattattgttgtcattatattaattatgttaatatagtttgttggtctcaaattaatgcaactcaaatcattcatgtaaactggaaataattaattcgattactctctttaggcgattgatttcaggaagtgactatacagtagtatttctcaatatggggtctcaatgcactctaaagagtaaagaactttctgatatagttgcgtgattgaaatgctgtcatcataggaagttagccaaaactatttgtgttattttcttatattttggccttcatttctaattatccatcccacgtgcaaaaaatggtagttgtttttctactaattttgtttttctactaattaatcacttctcttatatttttggaaagtgtctttcatcccgtcacatgtattcacaaagatcaatttagttccctta

SEQ ID NO: 6054 - DNA, 1189 bp, Glycine max
  Soy_ogl_3811 Gm11:9387812..9389000 Cluster 26
ataaccattcggtttggattgtgtattgaccactttgagtgtattttattaggaaaacttccataaagaaggtttacatgagaaggaataagggagagaacagaatataagaatcccaaggagtgggtaacataaattaccacccaatagacaattaactgttattctgttcttcccctttcttactataaatcctctttatgcaagttttttgtaaggacaatactaatgagcattaccgtaagtgcttttagtattgtttttcgattaatattagagttttacctcagtaattagcgtagacctttaatgtctacctttattgcatgggttattgaggtgaaactccaattttgattgaataatatcaccaaaaacacctaaggaactacacctcattaatgaaattcttccataatcatgttgtgaggtcctgaacttgataatgtaattcctgaaatacaatctttcacctagatgtgatgctaaagcaaactgaagcgaagatatcttttaataagcaaattatatccatatgtatcttttatatcatcatccaaagaattctttgttttgaacataagacacctctttcgatacctactgttatcctatgattggatgcaaatgctgttgggttttacaaccttggttatcttagattggtgggagaaatacttaaaggatatgaacaatttgtttaaggttaaagataatcagttgaaagagacaagagaacctaataaagactgatgtgatttcaactgaatttccaagctgcaaccaacccattagatatactgcaaacaagttcaagcattgcctccttatttttacttcaactacattactatctcattttcttaagcaaaagcgtgtgcaaaggtaaagaggtaggggagacatcccaggaacgttggcacccctgctcctacctcaactctgctgcaccaacattaatatctcatttattgtccattagcgttatacttttgtatttccttataacatctctaataggtgaaatttaagtaatttattttgacttctttatcttatgttatttggttcctacattgttacattataattgatattatagttaaacaactcatatattttgctttaatggtatagttttaagcaattattaaattatctccttaaatgatttttaaataataaaaaa

SEQ ID NO: 6055 - DNA, 1200 bp, Glycine max
  Soy_ogl_5160 Gm15:48496801..48498000 Cluster 26
ttccatactagattaaaaaatctataataccattcccatgacaaattgtcctgcagctttatccatttatgccttatgacgcccataccaaagaaatgacaccaaacagttgaagagggagtaccttctcgcccaatttgaatggaggaagtccctggtaagggcaggtactacgcctggaagcatcccctagcccagactgcagaccaaagacaactttgagagcaattaatgcaattatggggaaaaaatctgcagtagtattagaggatagattgacataatagagggtaactattcacaaagagcgtattgcacaatctgtagagaatggtagatcttattatatactagtcacaatgaccataattctaatcaattttagacattcttattgaacacagccttaatttgggtaaatttgtattgaaaatatacgttcagcataattgtactgaaaaacttcttgtgcataatgatcttcatacttttaggcataagctgtcttcaaaatttgggtaaatttgtattgaaaatattttttatgacaggaatactatcatagaaaattacaaattgtgtattgaggagaatgaacgttttaaattattttattgattgaaagtaaattttgaatctgacaattttattggccgaaccatcttatcagatgttactaccaacatcatgagctacaaggtattttgtcactaatcacaaatatgcaaatgtttactaaataattcccaaaataagaaaaacttgagttttatacttgaaaccaaacttgactatccctgtcatggtttatgcaggaggagagaataacaaagataatcgtgtagatcatggctttgtgaggctgattctgacacattcaagtatgggattcctacaccattggaataccaaaaacctgaacccctaacgccttgagatatatgtgcttctaaaataaaaatacggatttcaaacatgtcatagagaagatgacgtatctcaaaagtggttgtatctctcagaattgtttacccatcaattagcttaattttgattttatctgtttagagataatttgggttgaggatgttcgatcgaaatctgcaatgaaattttcatgttctctcttcaaaaaagtaatacaaaatacatttatttttagtatataagttttgaattgaagtgtaaagtatgaaattg

SEQ ID NO: 6056 - DNA, 1351 bp, Glycine max
  Soy_ogl_6598 Gm19:45496050..45497400 Cluster 26
atcgataagtataatatatatcatattattattaatataaactgatattatttatatcaatagatcgatcttttttaattaaaaaatattaaactaacaaaatttaatccatcatcagagtacaattgatatttaatatatatttttgatcccatgcacttcctttcccttaaagtaattataatatcatagcttaatttttttattccaaattttgcaccccaccttgattacaactttctttatctcttattctttttcacaccatatattatatttattactttttctttctttcatcctttttttttccatcataatcggtgttctcaaggcgtatacacagtttttaagggtgtgaaaaatactttttttttatactccatatattattatcacacgttatgcaataagtaaaagctacccgaaagatcaatcagttgatacagggtttcatcggtacttgcatgatttcacatttatcaaagagctaattaaactccctgaacacgatcattctatctgaaggaataactgacatcataatcaaccatgcattttttttgtctcaaatattacattgacaatttaagtactcaacttataaaaaactcttaaatatctgagacaacctatatgtatatatacctagctagtataccatcagcagaaatcataacaaggtatggaatttaattaattcaaaagaaagagaatggcttccaatgtaaaggaaccgagaagttcctattagggttagccatccttccagaatcctcatgaggcagaaactgaaccctcaagtcttcacaatgaggattcatcaccacatccgagacccacgtttccccatagtaaatagcttgcactttcatttgcattccaaaactcagagccccatttttcgctttatctttacccatctcctccaccaaccgattctccacagagggttgattatcctcccacccttctcctccctttgtgaacttcaaatgcaatttcacatactcccccttgtccaagtaaaaggggtacgaagacgccacagaaagagcatcttctgggttatgcttatagaatatagtgaaatcaatgcttcggaaatagatgcacgacacgttggtgtttgtgaccgtaaacttggcatcccacgtggcagaaattcctccagtactccccgtggtggtgaagttggaaagatacattgaattaagaacgaaaagtgggggaatagggttttcctttggcgtccccaaacgcttgtatagaggtaataatattagcatcatcaacaacgtgaggccaaggaggtcttgaatcatttcgcatgtgcgtgcgctgatgctga

SEQ ID NO: 6057 - DNA, 1100 bp, Glycine max
  Soy_ogl_1068 Gm03:43191001..43192100 Cluster 26
tattctattcgtttctttaagagacttttcaattgatcccaaatttactagctaaattattggtttcttctctaataataattggaatttggaagacagatgaaattgattatggctattagtattgatgtactaattacctatttattggatggtactttttaatttgtattatcattagcaatgtttttcattgatatgtggcaattagaggggtaattcattacaattgaggtgagttatatatgtagttaactttgtgataagaatgcatagactaatactacaatcaatacaaaaaacactattagtgtgttgaaatcgtgcttactgccattagaaaactacattacttttttgttgctatcgcagctttgtttcctaatccggcaaggcagcaacaaccatacaaacaagttttttcaaatgtcaaatccaagttgacgaattcctagctcatatgattatccttttctgcatacatgttaatattgcccaaaagacttgacaaggtttctttattcatatcttcccccttgtgtgtgtacgattagtttgagtactcgctttcatgcgcatatacactccaactctcactgttaatcatattttgttctttcttgttaattactttaaatccatgattaattaataccacaatagtcatttgtcataaattaattctttctgccaaaagcacaatgaatcaagtcttgatgtctttaactagtgtcatgaccttgttacctttcatggccttttccatgactgtacactagagggaggggattggtaattggattttgacgtagcatgttcagttctttcaactgtctagttgccaaattaaagacatcttgggtagacgtttaaatttaaagataatgtctcctttcttgcaaaattagtgttagtttttatttgcggtgtcacgtttctcaccgtgtttcacgtttgctctttgaagatgaagatgtttgatggcaacaaacgagacttgacttgaattggatttggttttggtgttgggtttacttccactgtggctgatagctgagtaaactcacttataggtcttgatcaggctcataagtcataat

SEQ ID NO: 6058 - DNA, 1485 bp, Glycine max
  Soy_ogl_257 Gm01:50900558..50902042 Cluster 26
agtcttccatgggtcaattgccatatgaagactctgactctttgaggcacttgcatcttccagattttcttccagtgcccttctataatcagaaggtgaaagccattaagcctctggtgggcacttacaacagagaattatctcaatttcttctcggccaaagcctcttatcctcaccagcttggtcttggggaggtaacatagcaatgatatactgaacaatatccataggttatagggaattcaacagagtaatatcccattccccatttaaatcagttagatctttgaccctcaaattaagaaaattggaaggaatatgaggaataacatcaatcaatttaatcgagccattgatccatttttcctgccaaacattaatattacccccatcaccaataatacaaatttcattctccacaatgattggccataaattggcaatggctttccagatatgggaatttgcagctagagttaggatttggccagaattaccttcagctcctctattgtattttcccaacagcacctcgccccaaagaccatacttgtaagagcgtaaggcccatcctaacttcatcaaataaaccttgtccatctgcactaagttagacatcgccataccaccatggtctttaggaaacatcatagttttccagctcactgcatgtattttcctcatcatgccttggtcaccccagataaaagctccctgggttttctgaatgtcctcaagagttatgcaggaagcgtttgaatcactgattttgcaagagttatgcgcctagcaagagaaagctgctgggacatccaaccagagacccgatgagccagtttttccacaagatactgaaaatctcttcgtctaggcgctttaccaagaagggaaacttcaagataacgacctaaagaagtgacctcattgaaaggagcaatctaaagaataccattctttatattttgatcaacgttctttgaggaaaaaaaatgcaagatttttcagcactcaacatttgacccgacatatgacaaaatttatctagcattccatgacatttcatttgatcaatggttgcctccccaaaaattaacaaatcatcagcaaacgttaagtgagaaatcaaaggcccacttctacctgccttcattggtttccaatcacccacttgcacagcttccataatgagatggcttaatttgtccatacacatgacaaaaaatatacggagacatcgggtcaaaaggagcagctctattaccatttcacataacatttgattgcaccaaagatatgcaatgcataatgacagaagcaagtttgtcaggaattcccacttcatgaaatatatccgcaatgaaggaccatctcatgcggtcataagccttgacaagttccactttaagaacaaagaaccacggcttcctttttatgagacgcatagagtgaagtatttcttgagcaacaataatattttcatgaat

SEQ ID NO: 6059 - DNA, 1100 bp, Glycine max
  Soy_ogl_1212 Gm04:4098201..4099300 Cluster 26
cggattattgaagccatagtccataaggctctttacaacatcttcaggctctatcccactagtattctaccaaagaaatagcttataattaagctaaaaatgagtgtatgtttagttctgtgttgtaaaattacttttgagaaaaaaaccattttgtcaacaaattaagactcttaaaatatttttgtggtagaattcattttaagttcttggattattttttttaagttttatagtgtcacataaaatgtaagaatttttttttctctagtagtagatatcattttgagttcttagtcgcttttgtgaatctcacataataaatttcacataagtatattttatgaattaattagaaagaaagacattaaaaaatcattaattttttaaaaaagaaccgttcttgagagtttttccatccgctagtcattgacctccattatcatgaataatcttgcatatctcatcaataccttcttcgtaaacaccacgggtagaaggatatgttacctataatataaatcaaaaccaccacaaatgaatatttaaaaaaatggccaatttggaaacacccctcccttccaaattcccaggttatccaaatagtgcaagtaaaattccaatataggaagcaagttgtaccataagtgcagataagttgtcctgagtgttttccccaactcttcaatattgacactggcaggatttgtaccatgtgctgagacaggtataatgcagacattgtgatggtggtctcctcttgcctatagtgtgtccaattgccaaaagaagtaagcagcacagaaattccagaatatatataaaaggcgggtaggggaaagcatttcacctgctttagatatgaaggaataggtaaacacacaaaaaacacaaaattaaggtaaccttttattggttgaatagcaacataaaaggttaaaattaaataacaaccgaaaaacttctttatctaaagtaaatcagacgaaactatgaataacgtgtgcacttaaaaaatcaatagaagccacactacccgagtaactaacatgcattgtccccaaaaggcaaacatgtacataataatgactaaaatcacc

SEQ ID NO: 6060 - DNA, 1092 bp, Glycine max
  Soy_ogl_1462 Gm04:47265239..47266330 Cluster 26
cttagagcataatactttgatgtgctaaaatttgtgaagtgtggggaaaaaaagagagagctagcgtgtgatgagagagagaaacaaaaaaagaaagatgaattttgataatttgaaaaaggatggaaaaatgagtggtaaaagaaattgttttcattccgcaaaggtggatttttattttttatttttttgatattcaacaggatcgaagcccaagaaaacaagaactacaaatgaattagtctttgagtcacagctccagaaacatcaaagagaaacaattattttaagaaagttggtgcacaatctaacatcacttgatcctccttcataacacaagtcaagatttgcaagcgcatccccacacttgttagcctcttgatagaatgagaaaaactaacttatcatcctgtattaatcattctgcaaatagcatttacaatgctccaccacgatgcacacccttctctgtctctaaataaacaattagcaactgcctgagaatccacatgaactcccacaatgccaaatccaaagatggattttcagttagtgcgttaagtaaaatcacttttgttggcgtggaaggtgttaaagagaaagggagactagacatgatggaggggactgatggagttggggtaataaacaacaccatatcccaacaaaaacaagtgtctaatttttaaagttgactttaagaaagcctataactctgtgtcatgggactttcttttttatatgatgaggaggcttggtttttgtgagaggtgggtaaggtggattaagggggcttagaatcgccttcggtatctacattggtgaatggtagtctgtccgaagaattttctattgagaagaagggtttaagacaatgagaacccaattggtcttttcttattttttattgttgcggaggccgagggtttggcgggtttggtgagaaaggcgattaaggagggtctttatggaggttatgaagtgggtaaggagaaaatggagatctcatttgcaatttgcggatgactccttatttatagctaaatctaccattcaaagtgtcatgtgtataaaagttatattgagatggtt

SEQ ID NO: 6061 - DNA, 1276 bp, Glycine max
  Soy_ogl_1507 Gm05:1156225..1157500 Cluster 26
ttttaagcgtaatttatttaagttagactaaactttaaatatgtcatgtcatgggcccttatttaaagcccagcctattcccatcattgggcaagacatgggttacacaattagtttatctatcatcaaacttaaaagaagtaaactaatcacaaccaatgtagtcgaagactttgagggcaacatgtaaatgagttgttcggcaaaaggagattttgaaaaatttgaactaaggaaagattatccatttcacacccaatgtgattgaagcatttcttccatgccttttgaagaccatgaagaacaaccatgatttcaaacttaatggcctccctacaaccattaaaggagtaaaagcctgcacatgagatccctattgatgatagcataagaccaaatcatcattcaacaacttatcttgatcaaagttcttgttactcatccatttctaaatccacacaacgaaagcgacaaacaggaatcctctatcactcagcagttgctccttgagccacttcttgacacagagatgagaaaccttggttaagaaaggaaccctaaccgcaaccacactccaatatagcgtgagggcaactacgaagacagtgcaaggctgactcgctaagctcaaaacagtgagggcaagcaacattgggaaccgtgttttttgtggtatctagtagcattagtaggcaaagcattatagatgaccaaccaaagaaagattttgattttctccaggatcctaagtttccatggccatttgaagtgagcaaaagggatataggtgccaatagtcacttgagaagtcagccatttatatgttgaagaaggatagtagttgcaatcactgatcaggaactgtaggtgcgagaacaagatccaccttccgtaaggcttgaagaatattatagggaaagatagtataaacctgcttaatatttcacgagtcattgtagataatgtctctcatacgcatatccacttctaagaagtgcacaaaagaaattttatgacaaagaggaccatctcttaaccaagaatcataccataaggaggcgtcaccctgaccaattacgaaattgaaccctaggactagtttatccttggttgcaataataccttgccaaatgtatggatcctaatgtttaaaagaaacatcaaccatgtgacccttgttaagatatttatgagtgagaagcttgacccacaaagcatcacaatcatcaacaaactatccacattaattttcctaaaagggaaatactagtttaat

SEQ ID NO: 6062 - DNA, 1013 bp, Glycine max
  Soy_ogl_1537 Gm05:1968101..1969113 Cluster 26
cactggcaacgactgaagaagtaggatttctgttaagacttctcaagacctatgaaatgacttctggacaacgtatcaatttggacaagtctgaactttctctgagccaaaacgttcccaccaccaagattgaatgaccttgtaagggttcttggagtgaaggctgttgaaagtcatcctacatatttgggacttccgactattattggttgatcgaagaaacaaatatttaactttttccatgatcttgtttggaaaaaaatcaaaggttggaaggaaagatcgttatccatggcgggaagaaaagttctgataaaatctattgttcaatctataccttcctatgtcaggagctgtttcttgtttctggtaactacttgctctcaaattgatagcatgacaagctgcttcttttggggaggtgatgataattcatggaagatccattggctgtcttgggacaaattatctcactcgaagagagaagggggacttggtttcaggatctctagagcctttgatatggctttgttgtctaaacaatggtggagaattctttgtgttggaaaactcattgttgtctgtcactcttgaagtgaagtattatcctaggactcatcctctctgtgccaaggtcggaagtaactgcagctacatgtgacgaagtttgatggagtgcagatgggtaatggaagagggaactttttggagaattggagatggtcaaacaactaggatttggccggacaaatgggtgcccaacctaagagataatcgaattcattgtgttcgcccagaagacagggaccctgacatatgtgtatcttttctgtttacaaaacaggagtcagagtgggatgttcaaaaaataaatgttttcaccctctaaagttgcaacttgcattcaggccatccctttacctaacaagaacagaccagacatgatcacatgaagcacacccaacatggcaattataccctgagattggactgtcatttgattttagagaaga

SEQ ID NO: 6063 - DNA, 1321 bp, Glycine max
  Soy_ogl_4788 Gm14:46420334..46421654 Cluster 26
tttattttaaacacactaaatattttttatttctttttatctcttctttttaatcacatcataaatttaaattaaattttatcgcacctatcattttacctcttctctctctactctctctaagtgttgaatagcaaatgtgtaatatcctcctcctccgtttggcagaatgtgcatctcgactgcaccctcactatctgaacatttctcctcttgagattctaaatagaaggcaattgatccttaaacaacctccaagtaaacacaggtatggtcagcctcaggagaatatgccaaagaattatatattgttttcactgagaaattaataacccagaggttgtgtgtttccaatactgcatattctctctatcctgtaacagaataatcccctacaaatgtgttctaatactgcctagcataaatactttgtttttgctcagagttcataaatagccttctaaactttgtagccaaacactcaaccccctcccacggttgatgccataacaagatttttctgtcatcgcctaccttccaagccacactcttatcataacattctttatttttacctacacgacaaacctcaaccaaatctctccaccataaggaatcattccttgatgacctttgaacttcagcattcccgaattttccatattttgattttaggactactgcccacaaagaactttgatccaaagcaagtctccacttccctaaaagagcttggttaaatagtctaatgttctatattcctagcttcccttgctccttactaaacaaacctcctcccatttgacccaagcaatcttccttttattctcctcacctctccaaagaaagtttctttggagcttaataatccttttaacaacacacggtggaacttagaaaaaagatgcataaaaaatggcaatatgaaaatagcacgaaattaatgagtgtgactctccctcctggcgaaagtgatttttgtttccacaaagccaactttcccttcaccttattgatgattggttcccaagttttacctcttctaggattggccccagccgcgagatgatcgtcaacttgcaatttagcatgctggtgaaagtatccaataggttatctgataccccaatgcccaccaacttgcttttaaagaaattgacctttagccttgaccccatttcaaaacacctcaaaattatcttcaagcataaaacattttgtatagtggggtctagaaagaactaattaaaacatcatctgcaaattgcaaaattaagattttcacaagattttttccaacctcaaagcctttgtggcgacc

SEQ ID NO: 6064 - DNA, 1197 bp, Glycine max
  Soy_ogl_4842 Gm15:844104..845300 Cluster 26
taataggtgtaccgtgtagtgggaactggatgactgggttttcctaaatcatcggctattgcactgcactgttattacttcttatgggctaactttgggcatgcatatgcaaattccctagggttttgattttgtttggatcgaaagtgattctctagtaacgcacttctagcctaggaaaggggggaataaaccagctaattcagaatcctcctcatggttgcaattgcacatcctttgtttgacaccatctctcagtctagttgtctagtgaccttgggcctccattaaagaaaataaataaagtaatcatgatttcccattagcctcttaattaaacttatgcaccgattaagccgtgtaaagtgcatatcatatttgaagaaatgtgttatttgtgtgctaattatattctagaaagaaaataaaatagatgacacgtattactaaatttcaagacgtgaaaacagaaggggaattagattcttgggaattaaactcccgtagcatcaacttgcagagacgtgatcagaccaggaggaggttaatagagaacaaccatttgactcactgatgaagctctaaatttatttagcatcgtggaccgtgacacacttcatgtggaatacagtacacaacattctagtgaccgagcttgtgaaatctattttctcttgttaaatcaggtaaagttatttgaaaaataaattttctgtcgtaatatattattaatttagagagattaaaatactagttcttacacttcatattttatccaacatttatagagatttaaattgagtttattaaacaacaaaagtcaattatcacaaatattaattattttgttttttttttctttttgttcaacctcagctacattgttgatccaaacctttttttactttcaaaacagttgtgaaagtagaaaggagattcaaattgtgcgaagaatttggtggtttgagtagtttgatgagtggcgttggtcatgaccgatgctaatatgtgtgactttgggtgaacactaacattatcagttttgttaaacacttatgtataaagtcgaccctttttttttattcatgctttgatgttagcagtgattttgtggtcaatgctaagttccattataatgtcgaactagtggtcaatgcaaagttgatgctaatatatgttgcctttcatgttttagtg

SEQ ID NO: 6065 - DNA, 1287 bp, Glycine max
  Soy_ogl_5447 Gm17:1355314..1356600 Cluster 26
ggctaagagtgcttatgccaatttagaagcatagagatacacaccctcataatgtaaaacttccccctttgttgcctcaccattctcctcaacttggaaaatctcctacccatgtttcccattttgaagttgtgctgcatgtagctccaatttgggcacaatttattgaagatataaaatccgacgtggcatggcaggagactgcaatgtagtgattggatccacgtgttggatttgcacgcgctcatgttaaggctccacttgtacttgaatttcacatcagagtcacgtgccttctctttccaaattcaactgaaacgctaagttttttagttaaatcatgccggccattagtgaatgtcgcttcccctgaaagcgattagcaagtacaaaaacaccagccttatcttcaatagtagtgtggctaaactaaagctaacaccttatcctctttaactttcttgatcatcaagcagttcaaatgaaaggcatgaaataatgattttcacttgagccttgaagatgaacccaacaaagataaacccgaacttcaacatcactccctctctttggtccactcctacttccaagaccttgatttgttctactacttaaaaatgggttcagcatgtgacttacaagcttgtcaaataatgtctcactgtttataaaaaaatgattggcactcaaacgcttccacagtcttacatcttatcttttaagcataaaagtgtcaaagataagatccttagcatgtataactgatctttgtggacctttgggataagtcctaaagatgtccagctataatgggtcctagtaaaattggcaagatgaaatttgagtcacaaagaggcttatagctacaccaatgagatggaggccacttgtgatcaaacttgggacatgttatttcaagtgttggggttttgttctgtttttggtcagaaatgtgaggaaagaaagttccaggctggtggggagacctactttgacttactatctgttgtgtcttttaaagaacagtggtggaaaaagttaggtgatctgtgtagttcaggatgtgactaactgagactacacaggaccagtgtggcaacattccctttagggaaacacttatgaatttgtgttcaaattatgtgagtggaagatatattactttgctgattgctactaagaaatatgacgtccatttgaaattggaacaactagaagatgacaaatcagaactgaataattcagcatgaataaataggagacctatctataacttgtgttgtattg

SEQ ID NO: 6066 - DNA, 1000 bp, Glycine max
  Soy_ogl_5906 Gm18:2652401..2653400 Cluster 26
aatcataaacatgaatttgaagtggtacttcactaacgcatgcattcaaaaacaaaattcctccctaatttattgatgtaagcaaaatcaagaagacacctgggaagcttgcatatatatcaatatattaaagggtgtttgacgctctccactcagaatcaatgccttcattgtgaattgccttcattgtagacaatttaaccctgaaccagattaaagaacaacacataaaactcatataaagcggaaacaaaaaagcgtaagcttcaaacaggaaattggattaatactgcatgtggttgcaattctttttttaaaactccataggatcctaaaccctttttcattattatttggttaatttttatggaaacaataaatggaatatataaatatttatacattcgctataaagaaagaaaaaaaaaggtggtgcgcgcgtttggaacatacaaaaagaaagtgtttgatatgccatgggatcaacaatgcatccaacaaagagtaaacaagaattagacgcaaatcacattgtctcagataacttacgcaatccgtgtagaacttgagaataccaaagaaaaagataaaaccaaaatcaagaatctaaactcgcctgagagaaaatctagagagcgagtctatctgatcaacaatgcaaataacaaagagtagacaagaatcaaacacaaatcacattgtcagatataacaaaatgctttttaacacgagtgcttcacataacagtgtaagatttgagcccaactcctttctcaatgatacatccaggatggaccaatttgacatgcatcaccaatttggcagtctcatgcacaaccacatttcccacagtatgtatgagggtcattggccagttcactaagagaattattcctcagccagttcaggtagagtctcattccagaaatatagtccctttgtccaatttccatctaaaatccttcctgtggaaagaccattgcatacagctttctatcag

SEQ ID NO: 6067 - DNA, 1300 bp, Glycine max
  Soy_ogl_6267 Gm18:59135301..59136600 Cluster 26
gtacataaacattatattatgtcttcatttgttagtgtactcacttaagacatacaccatgacaacactcccatctccctcactcctctttatcctcccaaaccttaaattctccaaaacacgtgcccagtgtgtcaacggtttgctttgtatccaccccaaatgcactgttaagttttcttctcgtgtcaatgctttcactctcgtagcaaaccccaccactagacaggttattactctcccccttgatcaatctatagacaaagattttgcaagtcaactcattttggatacaacgctgatcaagatgagttcaaagttcttggcatggttatgtatcaaggtggttctcatcatgaggtcaaggttttcattgtgacacttcatggagggttatttctcctaaaagacactatgctttgatgtaccatgaccttttgtccgcttttggtaagaagggcctttgtgtgaatggtgctatttattggacatgttcaactggtcttcttagattcgatgtggggactgaacagttcaggggtcatgcctgctcctccaagatatctggagggagttgtttggaatttgaagcacctgaatctcatggaaattcatggttgtttgtgtttgcctggacacacgtacaataatagcagaaatttgaagttgtggattttgatggactacatgtgggagcaacaaaaaagtgttgtcctcccttctagggttatttttccactctgtagagtccccacaggtgagatcctacttctgccatattttcttgatagatgtgttggagaagcctacagtgacatggacacaacaagctccaggagtcttgtggtcatggaaatgccttgtgatccattgtggggtgatcatacattagtagactttgacattttctattctcaagaaagcttcaggctattaagtgaagagacttagtgcatatatatttgttttattgttgcaaagagacttttagggcaaaatgagatttgcaaaagcatccaaatccttcattttgcaacgttgagtttgtgaaccattagatttttcttggaattcatgcaccgcatttagaacggaaatctaagcatagccttagccttaggtttatctctttttagatagcaatactccttcttgcttgaagagatgttttttttataattgtttttatttccaaacattaagggctttatgctttctgggtgttatcttaaatggcatttccaacatttggaatgacattgcttttgatgttctgtttatttctggacgtaccgtgaca

SEQ ID NO: 6068 - DNA, 1437 bp, Glycine max
  Soy_ogl_6795 Gm20:36839364..36840800 Cluster 26
atttcctgaccaactagacaaaaaaaattaattggttaaatcaaatttgaaaatttcttaaaatttactcattaaaaattatgaactgaaattttctttaactacaatcacaatacgtacatttcgtgtgtttctttggttgcgtttgcgacgcagtcgctacagaggtgagagggggacgtcaccccagcagaagaacattccgtagacagtgtcggagtggtttctaccggcgacggtggtgttgtagaattgcttgatagcagtggcgttggaagatagataagatagaaggctcctcaagttttcatttggaaggcgctgtttggagtggtaagggtcaggcttagctttctgaacaaaagtggtacttccaaaaacgtttttcttcactccttaaaattgatgaagctgactagggtaaagatgtagacatgctttaaggaagccatggacttgtttgttaattaatcttagctagatagcagtagcactactatgccatgtcattgtggagtttgccatggcaatggactgtacttaaagcttgaagctagacgacacaagtcaaaaagcacttagtaaacaaaattttccttcattttcttggaagctgtattccagttccaaatcactttccattcaataagcatatatggacgttaagctctatctattcccagcatttaatttttcgatccgttcatatgcttgctgtggatatgtttctttgagttccccattgtaacccattgggaataaattttcatgcgattttaatattttacagggaatcgaaaaaagtgacggataatttaacattaatcccatgcgcgcgcaatatggagtattttaattaagtgtatgcattagctgtaaaacttagacccgtcaatctttaattgcatacttctttttcagaattcacacacgtacacatagctcgtgaatgccaaatcaacattttccattttcgtaagaaaaatttgtaattaaaatctttataaaaagaatactactgtcaaaagcatttaatccaaaaagttgattcaatcatatttataatcttaatagagggatttttatataaccataccacaggcagctgaggaatatctgattcacttgtttgaagatggaatgctctatatatgcaattcacgcaaggcgtattactcttagtaagttgatataattttttaaattctttactaaatttacctttcatcgatcatcaaatcatccatgaatttatcttccatattctacgctgctttggtggatgaatgtatttgttttttctttattacaaaaaaaaatgattattctattatgttattaattaattgcattcaaaagaatattctacaatctgtaatttgtatgatggaattttctttgggggatgcagtaaattctagaccaaaaaacaactca

SEQ ID NO: 6069 - DNA, 1007 bp, Glycine max
  Soy_ogl_2 Gm01:312594..313600 Cluster 26
catactaagatataaatatcttttatacgctcattcaatcattatttgtcatgcatataaatttgttaaattttataacaattaccttagtcgtcatataaataataatttttttatttattgacgatgcaaaaactttttcaattgataatgtatccttattaaactcgtatagacaaatgtatattgttggatgatatataaacaaatgtggaatttatgtgaaatgatatgattagaaagataatatcaaatgactgattatcaatggaaagtttggattttgaatcaatgtcccaagcttgaaatcatcaactcgagagctcctcagtttatccaccacgcccttacaatccatcttgaacttgaactcattaaacccttaagatgcagcaaacttcaaagcccaagtttctctctcttgaatattacacagtgacctctagtcggtacacccagtatgatcgtgaacacaacactctgcagctgtgatattgtcatgattgcaaaaagtaacctcgcatcgacattgtatttcagttttcctgtttctggtgaacactagcgctggactggatgttgatcagtttgaagttggccagaattagatttcatcttagcattaacccaagcttggagaaaatcatcccctcgctgaacaacactagagtctgaaacaaccatgttttcccacagcttatcattcctcctcctccacaagctgcacaacagcatttgggctatgcgcacttggaatgtgagctcgtcaatgagttgcttcaacataactcattcctagcatccataattcgttgggcacgtgaaaaacatgtggacataaatggacaatcaactcccacagctctgagattcatcttcgtgggatgacaatttctgcacatcctctagagaaaaaccttcactctaattggaggtacttccaactcccatattagtctccaatccccatgcactctcagactttcgtaattagtgagcttatatat

SEQ ID NO: 6070 - DNA, 1100 bp, Glycine max
  Soy_ogl_1738 Gm05:38755101..38756200 Cluster 26
ggggacatgataccaatcttataagcaagaccacacacccaacgaccctggtgatctctaattaaagctccacaccccgccggactagcaacaccttttactgagccatcagtattgagactcatccatcctctccatttcacttggatttgatgatacggcttcccccgaaataatctgttgatttccataagaagagaaataagtcatggtgtgacctttaataacttccaccagcctgaaagggcctaataaaatgagggtcttgctcctttttgtttctccaaaaccacaaaaaataacaagaggtagcccaaagatcaggccaatttaaaccttgctctgacttttaagtagcattaagattccaagctatccattcagaaagatttagcccaaagaagtgggccccatcatccaaacattcgttgctaatgaacagtctctaagaacatggagaatagactcttctacattttgacaatcactacaataaggagagccaataccccccaagaagccacacgtttatgagtggaaagacgaccatgattagtctgccacagaaacactttcatcctttgagggactttcaacttccaaatcctctgccacacttggctgcagttaagctggtggaaactattaagtcgcttataagcacgggaaatggaaaattttcctagcctatatcaatagtccacatcctaatatcttcccctgctatctgagactgaggcataatggctctaatacgctgaataagatcatgaggcagaaaaaggttcaatgtatataaatttcattggccacaactagtggtcaaatcactgacagttaaattctggaactgatcaggaatgtcagtaataaagtctgcaactttagtattctcatctaaccatttatcattcaaagcattaaccttctccccattcccaatgacccaccactcttctttaaccagaggagctgaatgcttcacaatatctatccacaaaggggagtcagttcctttgtaatccatagcctgggcaacattaaatcttctggagtattttccttttagcacattagtccacagattattctccccattt

SEQ ID NO: 6071 - DNA, 1051 bp, Glycine max
  Soy_ogl_6779 Gm20:36008873..36009923 Cluster 26
acttttttgtttataatgtaatttgaactgtaataattgattatttttaactattaagattctcttttaaaaaaaatgaagtatggtagattaaaagaaatagaattataaagatcaaatatataaataaagatgaaaaaataatttgaaatggttgcaagaaatgttttggttggttgtgggagtaatgtgagaaatgcattcccaaatgagagaaaagagaaactatcaaaaaaatgtaacttacatattttcctaaaaaaaaaaactaaaccaaggctagtgtgaagggtcaaccgttgagtcgttgacgggcgttcggtgttgacaattgcttcctacacctccttcaatttccatctgcacctacataatttataatatgccaatgtttctcttcttcctcatactgaccacattcacccctcagcctcaccctctcttgcttctgacggttactctgtaaccgcctctcttcattcgttattctctcaacaaatgtcattctccatagtcacagtagaatgtgttggacgtaacttttttatatatttttttcttttggaacaccgaatacgtaacacaaattttgttaaacacttttagatttacaaatccagaaatatggaacaaaatttgtgttacggattcgctaatcagaatatgcaaaaacaagttctagatttgcatttcccaaaatgtacacagatgaatatatgttacaaataccttaatccaatagttatttgttaaggatccggattaagttttctagaaaaggatttgatgcaaatagaattgtattctggaactgttgcaagctaccttcaacggtgatggttgccttgcctttgtcggcggttgctgatacggtaggtgcaaaaagaaaacaaagaagaaagtaggcgaggtggagatcccgaggcgaaaaaacatgaaggggtggagattagggtttgatgggattgcaagttcagtgtaagagacacctaagcacatttttgttcgttcgatttattttaaaattcacatggggtgcaggtggcaattt

SEQ ID NO: 6072 - DNA, 1000 bp, Glycine max
  Soy_ogl_6998 Gm20:44754801..44755800 Cluster 26
ataggtccactaacatccccaacatttggtggccttgtaaaggcaatagatattaactttattgctagctctaatcagttttttgtttgctctgtaatggtgaatcaacaagcgaagtatttggcaggcatctatgcttcaacttctcatgttgtctgcaagcagctttgttcagatctgccatcccttcaagatcaacacttaggagcctggtgcttcattgggaacttcaacaccattctcagctatcatgagaagcgtggaggaaatgtctcttctcaaaactcttgcaaggacttccacgcttgggtggaggcttattctctaactcacctccactccttagtgcctttcttcacttggtctaatgggagaagaggtcagcaagatattgatattcgtctggacgggtctatttgtaatgaggctttcatctcctattgggaccaaattagttgcaatgttcttcctcggtctagctcagatcatcatctgcttcttctcacgttgaatcataccactatgaggctcacttcatctttcaaatttatgagtatgtggttagagcaaccccaatgttccaaggttatctctgacgcttggaggactccagcggttggctatcccatgtacattctatagtagaaattgaagaatttgatatttgtcctcaagtcttggaagaaaaatgaggtttgcaacatacatttaaaagtttgaggctatggacatcttgaatagtgtccatctacaattagataattaaggtcattcggaagagttgttggtagctaaacaaaagtctcaatcctccttgtagcaacttatgattatgaatgatatgttctggaaggagaaatctaggataaagtggcacaagaatggcgaccaaaacaccagtttcttccagacgatgactaagatcaggaagaaaacatagcatatatttcttcttcatgccgaaacaggtcccatctctgatacgtctggcatgaagagt

SEQ ID NO: 6073 - DNA, 1200 bp, Glycine max
  Soy_ogl_751 Gm02:49893801..49895000 Cluster 26
ggattttgctctatttctaatgatctttggatacacaaaaaagaatgaactttcatctttttcatgagtgtgggatcaaatatttcttacgtcactttttttccttaaatggataactatcgtcagatagaattttttttagcactagttgaataggcaactaatcctctagctgcgcctcttggcggcctcaacatctcatcatgtcttagccttttcattctatcattttctataccaaaaaaaaattataatttaaattttgatttttgctttttgagacaaaatcattaatttaatccttttaatgttttttttatagtaatatgaacttttataaaattttgtgacatcatagaagtttgtcaagtaatttcaagaaacgaaaataaacttcttctatcttcataatacttatttgatatttaaacaataaaattgatgtgaagtaaatattgtggggaaaaagtatgggcttggtttaagtggcccaataatgttatgctctgaaaccaaaaattggaggcccaacaatgacctggttttgcatcgttcctgttctgttcttcaccgcgcctcggtttccattccttcttcttcctttgtgtttctttgcgttcattataccattcccatggctcaataatcgttgctttgttcgttgggttcaagaaaaacgctcaaaatttcaaccatggctgcaacccttacttcaagatgttctcttcgtaagtccttacttttttattctgcttcatccccagtgttttctcctgggttttcataaaagccttcaatttttagctattgagcaaatttctattaaaattctgttatttttttttctattagcttagagtcattgagcaagtgttatggtaataagcatgcatcagtactgtggttggattgttattgttggattattattggtttcttacattttttagatctgctaacagttttgataaaatattttattttttttaattatagttcatgcagtcacactgtatataaagaatttttatcttgtcatccgatgataaaatgtcgcttagttttactttgttgtttgcttttttaatagtcaatctgaagttttgaaatttaacatattaagctttgtgtaactcggtaggccaaagtatgcattgcattcattatgtgatggataaatctccttacatttttattgcc

SEQ ID NO: 6074 - DNA, 1061 bp, Glycine max
  Soy_ogl_323 Gm02:2289501..2290561 Cluster 26
aatttattttgtcaactaccattttacaaaacttatagcatttcattgataagcaacgattcaatacacctagtaacatgatagaaaactgagagactacgataagatggatggtgtcactctagacaacctatgaacaacactatttccttgtctctttacaaaagattcatttaaaacaaagatgttcctacactattgaataacagagcctatgtcagactcatctttatcgaactcttcaaattgtctactacccctttacacagtccatctcaaagataacattaacatacccttttgcttgcataaaatttataacttctaaaagtccccaagcctctcctagctgggcgtccatgcaaggcattttagtctcagctcttgccatcatttgtctccctcgctcatcccttacgcaaccaggctcaggtggtatccaatgtagcacttgagaatgctgaaccattgagtagtgagatggttcactccttctagccttgttccaattattgaaaaacatatttgttctatggaagacttcctcattcgaagcttctttctcctcccacagcttaccgttccttcgtctccacatactccataacgccatagatattcgctgctgtagagaagtgtttactgactgcataagttgaaaaaatagttgccccaaatcatccactcacaacagcaaattctccacttgttggtggatgtttaaaagatcccaatagcctacattaacatggcatgaggcaaaaatgtgacaggtgttctcaatatcaatgttgcatagagggcatataatagggaaagacactccacgagtacgtagcttacttcgtgagggaagcaaatttctgcacattctccataaaaatagtttaactctagggggcacattaatattccagagcaatttccaatctcattcaactttcagctcatcataatttataaatttcttcataatcatatgataagcactacagacagtgtacataccattttgattaagagcccggatgcgtgaatctccttctaccataggcaagaga

SEQ ID NO: 6075 - DNA, 1067 bp, Glycine max
  Soy_ogl_344 Gm02:3263334..3264400 Cluster 26
aagcaattttacattcggaatggatattactgaaggataaagggaagtgcagcaaacaatatcctttggtattgttggtttgactgtcccttttgagtgagcaaccgagcactcttataggagtatttgttctttcctttgggccttttgtggcctgtgttcctttctaaatgggccgaagaaaaacataaatgctaacaggccgaaagatggtggattaaccaataattatttctgcatacttaaacaattcaacctgtaacaagttaatgtccaattacttttgctcctttagtttatttgacctcttatagtttttttatcaacttattaaaaattggatttaattgtttgatttctactttatggatttcttgtgtcttgttgtcaatgtatttaaaactccatattcaagtttgttaccaacttataggggctggggaaagtggtgaagtgacaaggtctgatattcaacccattcctgggcagagtgggcaccattgtagggtttccttctgctaagcgcgcttatgatgtagttcctaagctttaccaaaatatggtgtgtgtattgatgaatcgttttatgcagagtgtaacgaataggacttttctgaaacacacacttgacactacaatgttgtagaggtaagctcatagtgtagtagttcttgaggtcttgtgtttgtgtcatttatactgtcaacttgaccaggactgattggagtgcttattgatgaaaataaagtattttctcttccatctttttattcttggacggctaagcattgctgaaaatgctcccattagttggcttagtagagaccagactcaattattttcaatcaccttgatgatccaacttcattacatacttaccctcagatagtttctcccctggtttaaagctctcttgcagccattggtataagagaactttctatagataacatctctaaacaagaaaagaataagacatatctgactaaaagtacatgctgaacataagtaaaaacagaaagcctgcttatacattccaaatgtgattgtaacacagaccaaaaaaa

SEQ ID NO: 6076 - DNA, 1043 bp, Glycine max
  Soy_ogl_740 Gm02:48995158..48996200 Cluster 26
gttagtgaatctaaaatttgagttttaattgttttatccctaggtcggtgagtcgtgactaacgtcacactcttttaaacacatttcttttaattgtatcaaatcaacatgttttttagataaggcacttgtttaggttttgtcattttatttgattattgttattaagaaccaaaacattgtctatccaatattgttgtctcgcctttctcgatgacccttagtgcaatctcttcccttgggcagtgatttgaaggatcttgtttatctacaactagtttgacaggagtttatcgatcaccatcaaaaggttcttcaagactctatgacttgggttaactcgtgagcgtagattgtgatcaaacgcaccctgtgcaagtcatatcactcaacaacttgttcatctacacaaccattgctctacctcccctttgtttatgtcaccctcatccttggtggttttgactaagtgttgagacaagaccaatattattattattatctttgattttggagatacacttttgaaaaaagataatttgagtatttttgtgttcattgctttggttcttaatagtaataaaataaataaaatttgatacaatgactgatataaaaaatatgatgatgtggtccaataaaaaaatgtgtaaaagtatgataatataaagaagaattttacaacataaaaaatatattggcacataatataaaattgcctctacgtagcgattttttttataattatataattgattgaatagtacttttaaatcttttttcaacacacttatgttagacaggaggtttgggtctcctcaagatttttcttttagaaaaataaaataatgaaaaatatttaacctcccgtttctatacgacatgtcttcaaagtttaaagtccaccattccaccaacacaatccatgatggtcaatactatggtgtttggtaaagatagttgactttgactttgaaacacaatttccatttgttttaaggcgatgataccactaatctaattttcatataaggataatggga

SEQ ID NO: 6077 - DNA, 1165 bp, Glycine max
  Soy_ogl_3683 Gm11:2210801..2211965 Cluster 26
tacgaggcttcggtagaatttttcaaaaactaggatacgactacaacatgatatatattaaatataaatagaaatataaaaaacataataagaaatatatgaaggctgcacatgttttaaaggtgatacctgtttttttccatgcattcagtaccaaaaccaaactgaactagttaacgtacattacctagctagctttatagtgttttacacaatgatttctattcggtaaataaacatatatatctaatgtatactaaatacgtaaccaggtagactcatgctgtcatgcatcatgaatgttatttcatatatcaaacaaattctataattaagaaagtttccatattccattctcacaacgcatacctgtgcgtgaaagttggctcctcctaatgaaagatttctctaattaccacaagcatcttctggtggttcagcagttgctggggtatgctatatcacagggtctaggcagagccgtctgtattcaaaagttgatgggttgttatatatatatacctgcaacaaggcaaattaatcttaagcacctaatcatgcatggtgtttaaaggtaactagtaccgtagttctatgtgttggggtcattggatgttgatgagggatgaaattcttttgtcggagtcaacaattaaaaatttcctttaaagcaatggcacgacgaaacaatgattaggcgtgcgctcatcaacttaatcataatgctgcaggtttcaactgtactctgtctcatgaattacttacactaaaagacagaaattaagtgtgagaagtcggcatgcttgcctcaaggatcgatggatgaaaagggaaaaacgatttaacaaaaggtaaatatttttctaacatcttttgacttggtacacagttctctgtctcactagctagagaagagaaaatcaattgactcgcgtttgctcggcaaagccaaaactagtaggccatgcgcactgaggcggcgtgagactgagacgactacaataattattatttaagagttcttcacattctacggtagccatattattgactatgtgagtgtgataaaactgatccatgtgaagataacaatagcatcatcgcacatgcgcttgtttagttccccaaaaaaacattgaattacttcctgtcgtgtgtgtgtgtg

SEQ ID NO: 6078 - DNA, 1200 bp, Glycine max
  Soy_ogl_5317 Gm16:5375901..5377100 Cluster 26
acccatagaaagttaagggttatacacgaatttgattattcttagtcgagttgttaatgtgatacctcgagtctgacacatttgagggattgatctacaagacctcgacattctctaggactagtatacgagaacctttgtatggtcacatttatgagctattggaaggaagacccaagtgcctagtccaaggcctgtgaatgcctcattattaagtctacaatattgacaacaatattagagttgtgtccataatgggttgaaaatctagaactagaactttaccctgtagagtttgagtttttataatttaacaaagagtccaatacacaactttttaatagatgaatgcttagacctttgttcctcttcaataggcatcaacgtgcattgaggcacacaaagaagggcccctagtttgtcacaaatctccttaacgcaacatcaagttgtgataacttatttgatgacaacaaactcgatagtttgtctaagattcttcacactcttttgtcatgatccctcaatttcctgaggcacgtcattgctagaactctcacaaaattcatttcccaaatacccatcaaccaaaaattgaatctatagtacgttcttcttttcacaagaaatcaagattcatgagacgccaaggggaagccgaagaccagcaactaagggtattatacgagctatgttccctcatcattcacactctcaagtttcctccgttaccctatttccccacctcgtacccatgttctaggagatgttctatgttgctgcacttgtctccaacttgtctgtgttggggcgtttcattcttgggtccatcacgctgcagagggatcttccacgtcagcctctttctctcttcttacttccttagcctatctatgcctttcatgcatgcttgtttcatagtttgttcttcaatctatttttttttttactaattattctctccattccaaattatatgacaaaaaaatttgtccgaaacagatgtcatttcataaaatcaatgttgcattaaatattttttgaaaaattcaataaattaattatttttgttcattcctatgtgaaatcattaaacgccatatataatatgaaatgcagaaagtattaattttagatttcaatacttcaataattatatactaactactaagatgtaagttcattaaataagtattaagt

SEQ ID NO: 6079 - DNA, 1018 bp, Glycine max
  Soy_ogl_5322 Gm16:5522101..5523118 Cluster 26
taagttttacctttttacgtattcttcaaaaaaaacaaaattacctttgtacttgaagaagcagaaggttgcctgctgacctaatccatgcttatgaatttctgcatgcacttggggagccttaaaaatagttaattctatgataaaatttctcatagaaactggtccagtgtatattaaaatttctcaatcaatcactttgtttagtttattcatgattcaccaatagaacatatgtttactggacaaaattttcaaaattcagtaaaattccaaaatcatggacgaaaatccgcataattggattatgcccaacttcactatgaaattccatgatctctaagacaaaccatactctcatattgtcaagtgtaacagccgatatcagaaccattcttacatgattcctgggcaatttatacaagcacaatatttgcagcattccacattaattcgtcctctcatatataggggcaaatcccttcaataacaccgagcagttgaaacgatgcccaactcatcccatgaccgagaagatgaaacaatgtgggaagaagtactgttaaaaatagcatcccagggacgtggccacatgatcagaggatcaccactgtctaacatgtacgaatccgcacagtactgttccgatgacaccatgtaaaaatagagaagagttgtatggttcacttcaaattcatgattagacaaaattttgaaaagacgttgatgttggctttgagctaaagtcttcactactctcttcttggtgtacttcgcatgaacacagaccaacaaaaaaattcagatattgaaaattcaaaatcacatttgttacaaagatgaaaattagtaggaaaaagaccatgagaaaagaaaacaaaattgtgacagccaattctatatgacacaaggctatcacacttaaaaactcagaagagatcacaaatgcactagcaagagcacaaaatctaaatatcaaaacatcgaaagatacaacaagccttagcagccacttcca

SEQ ID NO: 6080 - DNA, 1016 bp, Glycine max
  Soy_ogl_408 Gm02:5851985..5853000 Cluster 26
ttccaagcccccttcttccattgtaactcacatgtatggattgactaacttgtgtttctggtggagtgggttttcttggagaagattttggggtcgatggactttccaagtaagtggtgctctctcatcctcaataaaaccaaagtttcatttagtcaaaatgtgctgagttccagagtaaatgagctagaaatagaaatgctaatgggagttaaggcagtcggagaccacgatagataattggtccaggttgaccctatctgtcctcgatgaggttgcgcatgctttgatcatgtagcaaagtctggtttgcttctcctcttgtggggtgtatggatattgatgagaatacaagttttgctgatgggatttatttgtgcttagagctgaaaaacaatgatttgatggaacaggttctaaatcttatgtggctaatatggtattccaggaatcagtgggtgtttcaaaataaggtaatcccattgtggcaagtgtttcaaagagctgcgataccccatatagagccagagaagaaacgaaataggtctgcaactgtgaacacccaatgttgatagaggcactggcttaggggtggtgtatcacgatagtgaagggatgttcttggcttgtgcagttgttctgatcacatattgctatgatctgaaaattgcggaggctatgactttcaaatggtcaatggagactgtatctcacctttccttttctcgggttaagtatgaaattgacagcctagaaaggaaattcctcgactaacaaaacatattttactttgctgctaagtgactgtgaacaatggtctcgccttccatcctttttcaaactcattatgataagaagaaatgccaacaaggctgctgattgtttatcacttttagcttttgctgttaataacatgtattgggttgaggaatatctccccagctgcaagaatttgtttctgatgatgtaatacctttggcgttgtcggcttaataaaattcttgattctaaaaaaa

SEQ ID NO: 6081 - DNA, 1000 bp, Glycine max
  Soy_ogl_1660 Gm05:32489901..32490900 Cluster 26
aaaaatcacaacgccgcatactctaacgaaggtaatatgtaacaaattagaggaaaatgttgaaggaaccttctcagacaaaagcacacaaataagaaaaatgtagtaaactagcatagaaggtgaaaaagagagagaaaatgtcaaagaaagtgggtccaaaatgcacaaacaattggcacatcatagataaaatggaagttggataggttatatatatatattgaaatggtaggaaaagcagaaaaaggagaaggatcagagcatgtaattgtggaaagggaaacaattttctaagagaggggtggaggaaaataggggataggaaataccaatctcgcattacacctcaggtagaggaaaagacgaaggaaaggccccacctgatgcaacaaccctcgttgaagtcaacaaagagaaggaatatgggtcaaactggaatcccttcacttgggccagtgatgaagataccttcatgcaacaacccagttggctctgggccactgaataagaacacaaaagaggattgcagaattatttctactggaagtgtaggaagtggaaatagattttggcatcttatcaaaggagctactggggggccagtaattaaggggggtctcaattctggaagaagaaagtttgtgaagggaagaaagcaaggtgatccgtgaagattctaaattataatattagagggttggggggaagtttgtaaaggtgttgatacaaaaggaggatatacattttttgtgtattcaagaaacaaagatgaagtagattttatattttgttgctttttatggggagatggtggcttacaatgggtagcttctccggcggaaggtagtgtggggggacttttatgtatttggggggaaaaaatatattttgagttgagaagtcattttgtggcaaaagaattcattgcggtggaaggggtgtggagaaacaatggcaaggaaataattatagtcaactcctatgcaccttgcgatag

SEQ ID NO: 6082 - DNA, 1100 bp, Glycine max
  Soy_ogl_78 Gm01:3291801..3292900 Cluster 26
gtggaattcaatgttttggtaaatggagagggtgttggacctattctactggggagatgacttagacaaggcacccactgtacccttatctttctttgcaatgtatggagggactcacttcccttctacaaaattttgagagaaaaggagagatccatggtgtgaaagtgtgtagaggagcccttctcctcacacttgttttttctaacgattgttttcttttttcaagacaactaaatcagaagctagcacccttcactcaattattagttcttttgaagcctcttcaggtctctatcaattttcagaaaccggagatcttctttagcagaaacactccaactcaaataaaggaacatatcacaactaaattgggagtaacagagtgcctagggacaagaaaataacttggcattccttctatgattggtaagaagaaaaaaaatctatttttgtctacttgagagatagaatttggaggaaaaatcatcattggtttggaaaacatttatctaaagaaggaagagaggttctaatcaaattggtagcacaagctataccttcatattgtatgaatgtttttcttcttccttcaacagtactggacgagatttagaggatgatgaactcattttggtgagagaataacaaaaatgcaagaagaggcataaattggcttagttgggatcgtttaaccatcaggagggagaatggaggtatgggatttagacatatttatacttttaattcggctgttaggaaagtaaggttgaaaattagttcctgaccatgatgttataatatcacaagttttcaaagctaaatatcatccgaagggagacttcttgggttcctttgtgggtcacaaccccaactactcatggtgtagcattcacacttcacagactttggtcaaaagaggcacaagacagagattgggtgatgggaattctgcaaaggtttggtcccatccatggtttagaaatcctggcaattctttattgcttctcttgtgattgatggtatttagtaggatgttcaaaattgaaccaaatcatttgtaaagggtgaaatcaatccaaaaaaataaaaaattgcaa

SEQ ID NO: 6083 - DNA, 1000 bp, Glycine max
  Soy_ogl_2419 Gm07:38325801..38326800 Cluster 26
gatagagtggaaggtgtagtgtactgttcatttcaaagggaagcgtattcttcaccccaaatcccgctcaaattctctatttctacacgttagcatttaaaaaatttctctcccaaaagttttgatttcgctcactgaacggatcccccatccccatctttgaaattttcacctctctcgtgtgatggagaagtaggatgaagggggggctgatgatgtaccaaacattacagcagtggtcggagtgcctcggttaccactctcagactcgaagattaggaccactcctttgattccaccaacaattacaatcattgattttcccttctctggtgcgtccaaatcccccaccatcaagatcagaaagatattaataattaataaaaaaaaatgttgtatttttcataatttcttcaattttgacttttattccatttcattttaggcatcttttgaattagtgactatagttggcttagatgaagactgttttatttatttattattatttctacaagaaatgacaaagatcaaaagcgaattattatttcttcacatagtgctgatataaagtatattgtgtttttattaggtgacacctctagatgaatttatttgcattgtcacacttcgaactttgtttctgagtggaggttagccatttgggaccttaaggctgtagtttaaatggttccgacacgacttcaaacagtggtgtctctgtttctgacacatcgacgatacggacacgtgtcagacatgtactagacacatgtcaaacacacattcgacgtatttaacttttttttaaaccttcgacatggttctgaatatggaaagccaatagacatgatatgactttcgtaattttttttcaaaatcatattttttaaaatcttaaaagataaaagattagattttaaattataataatagattaggtttttttattattttctcttcacgcttccttttcacgtcatttacgcttcatatttct

SEQ ID NO: 6084 - DNA, 1000 bp, Glycine max
  Soy_ogl_4965 Gm15:10072601..10073600 Cluster 26
cctatcctttatttttactttctctctaatattaggaattcaaaattccccatagccttaatgaccgtgttatctcagagtttcctccggacttttagttgtgagacattcacctgagaaagctcagtattattgacaattgagtattgaatcaaaaaagggaacaagtggaaggcgtgtgtgtgtgcatgcttaatttgctaaaacgtttgcgtcaccagaagttcattcaaattaagggtgtcactatgctttgtttttgtgtacaatcatattttcacaaatttctgcaagtcaattctatgctctaaatcatagatattttcacaaatgtaaccacaacccatctaccacctttgtgtaataatattcttttaatattatttgcagatcaaaaagcgatttttaacgaatatctccaaacaatattactatatgcaaaatcagttcatttaaaaactaatttttaattaaaattaattttacaaatacacaccaattacaacacacactagatcagtgtctttggctttgctcccattatttcataaccaacaattggcttttgtacgttcatgtttggttgcgaagaaggacctaatgcatttaaaactcgacgtcaaaagcagcgttgataactttttgggccaatattttttaaatacaatgacattatttaaaatcttaagtaaaatattactcagaattcttcaccattaaacagaacttgctaatattttcacgcttgaatggtttgggattattccagtgaaaaataaaaattatatgcataacagcctaaatttaattggctgcatcggtagtcgcgtttttcaattggagatcaaccacatcaaagatgatagcagcagctagagacttgaaattttttattttttttttgcttttgaagattagagacttgaaacttgaaagttgaaacaatccaagaaaggaaaacgtagaaacgatgaaccaaggaacacagtggcggtactac

SEQ ID NO: 6085 - DNA, 1100 bp, Glycine max
  Soy_ogl_182 Gm01:47156301..47157400 Cluster 26
tagttgccaagaggcgcaagcaaagaggatacccgacgggagttgaaactgtgaatgaagccaatgttgaacatctactgaatggaagtcattgctgttatcaagtttgagcttcctctaaactgtttttgaaatgttacagtctcataacatatgtaacatattttcctccaaagcaccacacttgcaacaagagagatcaaagaaatatgttacgaaatgcagttgtgagaactaactgggtttgcgatttaaacattaggctcttgtgaaatccatctataggcagaaggagttgtgtaaataccatcactgcctggtctcaacatgtaaatttctcgagtattagcatgaagggcaatgttcataagcaatgccttgacattagctgggatagcagtatataaatgattccactgccaaactccattaaccagaatatcgttaatatgtaagtcagaattggatatgtgcacatagttcaccataccactgataggtccctcgtccaaaaaggagtcacagaacaaggaaaataaattagaaaccacggatgtaagagtcaatcttgccataggttccttcaggcaaccaaagattctgcatggtataggtagggactgctgctagcacagatttagcaagagtgattatccctactctactcaataaattaatttttcaccctactaatttggaagtgattttgtgcacaatgaaggcaaaatgagcctttttaacacgtcctgtaaggagagaaaaccataaatatttccctagattggtagtatgattaaattcaataataaaggtgaattatccaacttccttccaggaatattgcttgaagccatatagatagatttactcacattgacttcaagcctgaagctttgcaaaacaaatgaagaacttctttaacccaaacacaccagcttagaagaagccttaacaaataacaggcaatcgtctacaaagaagagatgtgaaatagaaagcccagtccttgaatttttactgattgccactgacctaagtccactttctcttggatcataattgcaagtttttccatacaaagcaaaaataagtagggagat

SEQ ID NO: 6086 - DNA, 1000 bp, Glycine max
  Soy_ogl_2216 Gm07:5411701..5412700 Cluster 26
agaaaaattacatgtatttctcatttcaatatgcccaacatacatcaagattacaataggtattttagtttttttaaaaggagatattttaagttattaaatggtatttgtgataagtattctaccctatactaactcaatggtccatttcaaaataaataatgtaaaaaagaaaatcgtctaagacatgattgataaaatccaacaaaaaacacaaacggagagaaaaagtaatagaaacttcatacaaataagttttacgaggaaccatgattatacaaggaatcaacatcatctgtatatagttttaggtgtaacacccaaagccacaaaaaagaataggttttcacattgcagaattacatatttacgcaaaattatagcaaaataaaaagaataagaaagtttgaaacactaggttgaattttttaataaagacctttgctttaggtcaaaatcaataaattgttcacacttgttttttttaatatataaaattagtgatagtctcaatgcacaagaccattccttactacgttggcactatcttgttacccatgagagacccaccaaatatcattaaaaacagacctaaaagaggaacaaaacaaaatgagaggactacgtcaatgcccattaacaaagttagcaaaacctatagttaggtagtgtttgcctattatgaaggtactcatttctaacaaaaagaggggtgttgtcccaccaagtgaagctacactgagaattagccaacaaaagcagaaaagcatccttaaaaggcaaaagcatccttaaaagagagggtaccattttcagtgggacaccaaacagataagtcatcaaggtggataaagagcttgacctgcaaaatggcataggatagggagggaattctggcccgaattgaatccaagatcaaccactcattatccaaatgaaagtcatggatcgaagaagagagcctcaatctaatgttcagaggaagctagagagcatcagc

SEQ ID NO: 6087 - DNA, 2336 bp, Glycine max
  Soy_ogl_873 Gm03:336265..33653000 Cluster 27
agctacgatatagtattttataagtaaccttgtacatccacccccaaaataaaaataaaaaaagaaccccacaacaatattaacttattttcttcaagggccggggtatctcttaaaatgaaaatcctggaatgggcaacagtttttagttgccctatacatagagcccctaacctacaaccatgccaaggcacacaaacacactcaacgatctcaccaaattcgtggctacgcatacctatatattcacatgcagtgagatgaaaacaacaaggaccgaaacaaatataaaaaaagaaaagtaaaacatatacactatgctagaccttttttattaggccaagaatacaagacacaagtaggttcaacactgcaccttaccactacaagaaagtgacttgatattgacaagattttaccgataattatataaaatcatcagtgtgttacatttacgaaaactataactgtttttttagggtaaactacaactgttagtaaatgtcgtttatgaaagttaattatttaagtagcgtaacaaaaataccaacgacagccattttttggtaaaccggaggtgtgttgcgtacatacacatcattatcctcaccatgggatgatcttcatcttgatttgattttttttttttgtgtgtgtgtgtgtgactctagaccacaagtattttgcatagaaggcaattttgctctagcttgtaggatattgcatgacaaatttaaaatctcctaaaatttaacacaaatgtatatttagaaaacaaattcgaaactatcgattaaattaaaacaattacgaactagttgatttatgctttagataaatgataataggtttggtaacgaggaagattagatgcttcagataattgataatacttgtgctctggatatatagggtcgattaacagatttctacacatgcgaacacggttactttgatttatgctatgttattgtataaattaaattaatcatgtgggggtttctttcctttgttttgtagggctattaggatctctttttgtatttggttttgggtatctcttatacccatccttatctaatatatataattattttgccgataaagaaaaaaaagttagtaccctcaggctaaaattaggttgaccagcaaattccaataattaaggatagtcaacctatcatctttcttgccagtaggagaaagcatttgttagcttagttgtttttttaaaattgttttttcagtttaaattacatgatattattaactatatccatgatatattcaggtttgtgccatgcaaatataaggtgttcctggccatgatagcaatatctagtcctagttttaggaattgtatctgtcttgggaagagatcctttgatgcattggaatactagttcatcaccttctgatgaattaatatattaatttagttaacttttttattatagctttttactatgtatatatacatcgatttatatctcaatttaatttttgagttattgtcatttaacagctgttaaatatttagttaacttttttttataacttttttactatgtatatatacatcgatttatatctcaatttaatttttgagttaatgtcatttaacagctgtagctaactgataaagaatagaactaacttatattacagagaaaacaatcatgaataatcaattgcattgggtggtaatgttgaagaatctgatgttattctttcccccacttctttttgaagaccaggaataatattgctttctaatttttcataatcatgctgtcttttcacttttttccccactacttgtgactgcctaatcataaacctaacacgtaacacctcccattgtttttcaaagaaaggaaacaatatatgatttataaatctcgttttctcaaccactagctagaatcaatcattaaacagatgttgggttaagcttttaattttctgaaaaataattactagtatttacttttggaaagctcttacgtacaaaactaaactatctataattttccaaaataaactaaataaaatatacatgcattaatacaaaattgaaatactcaggagatacaatactttaggttttcgaataagctcactgctgtaaaatgaagctcccaagactttcttaaacgctgtaaactatgaattcttcctagtttggggtgttactgagccactagggcaccaggcaaggcaataactaaaaagctgatatcaaagtcgagttgtgttgtggtgggacattaatatccaaagaaaatgatacatctgcttacttctaaaatggcagacaggggtccaagattttt

SEQ ID NO: 6088 - DNA, 2100 bp, Glycine max
  Soy_ogl_5348 Gm16:26596801..26598900 Cluster 27
tccagctatagccctcggttcaaaatgctccttaagaaccatgtctgaagggttaaaagattgaggatccatagggaatggtgctgacaatagagtgaattgcatttcctggacaaaatgggaatttgatgagtcccgattgactgcagaacgaagactgttagttctgttgtcattattttgtgaatagtgatgctcttcattgtagtcagaggaaaaatttcaagttatgataggttaaatttaaatccatataagaaacaatatgaatcattgtggaatttactagttattcttgaaattttatgacataatatattgactaggtgaggaactaaaatagttgacagagaagcaatatttaatttataaaaaaaatcaagacaaagtatttaaaaaaaaaagttgaagcttagaaaatcacttacaaagttggagaacttggttagtttgaatgggtagaaattaaatggagcttcatccaggaagagctctatatagtgaagtagaaagagaccacaatcaaacgagttatcttgttgcggcgactgttaattaatggtaagaaatcttttaaagaatgatcatttcagtttctaatcagaaagtcatgaaaatgttagcatgtaataccgggcctgagagaaaatgcatattcaagaatcttgatgaaaggtttactccacatgtatccttctgcctctctttccattcttcccacaaataactgccaattgatgagtcaatttatcactcactacaataatcttttaaagcgagaatacataaaaatctgggtatcaaaaaagaaatattcaagagaacaaacatagataataggcaataatatgtggaccaattgaagtaagttaacagaaaacagacagctacaaaagaaatagaacatgtgaaggcatagactatgctgcaactgtaggcacaggaattttggtattgcttcttttcatatttttgtttaatctaaaatcaaagattagaataagagaaacaagttcaaagttcaagctcaatttaaattagaaagctaaagaaccttaatcatatagctagcgctacagattataagtttcagtgtgatgttttacaaaatttttggatatcctaactaccaagttcatcatctcctccataatctttagaagtcttaaattatgaaattcaccactataagaaatttgaaagctaaaagttaaaacaacagctagtccaggaatggaaaaataagagcaacaatcgtgtaagttttagaatctgatatatctaaatcagttagagagtattacttactaagttgtacttgtagatcatggacatgaaagctatgaagataaagcatttttaatgattttaagaatttctgaagaatccactatcaattagagtatcttccattcttaccaagtttatgcgggccatggacatgaaagatatagtattctcacagtatcagtctaagaagaggacctatatctccatgtctcctaagaacctgttaataaatttacaatgatagacaattagacatgacaaattataactataataatagaatgagagtagttaaaattacaaatttagtttattctattattatatagttcacaaagaagggattatttgaaaatcattatagacaattagacatgacaaattataaccataataatagaatgagagtagttaaaattacaaatttagtttattctattattatatagttcacaaagaagggattatttgaaaatcattaatggaggtcatactgatttatagtattttggacatcaaaagcttggatgggtattgacggcatttgataaccaactataaaacaaccaaagttcagaatgaaagacatttctctattttcactctaattagttttaattttcagtgtgtaatttgttaattgtcaatgaagacaaatgcttatgaaccagggccataaaaaaaagcctctagcatataagtaatcataacatgctgatcagaggagaaatgatatccttcacacatgaaagaattaatatttgaagatagttgtatctaaaagtgaaaatcattctaagcatattaatt

SEQ ID NO: 6089 - DNA, 1900 bp, Glycine max
  Soy_ogl_3815 Gm11:10068401..10070300 Cluster 27
attgactaattaatagtggtaagaatgacaattgcactcttcaaattgtgaattctacttctaacttataatacagtactatagtgatagatgttggtggccggaaaagtgaaggacatggaaattactcggtgaaattggcttattcaatcgtgaaggagaatagtattaggaaattttgacagaacacggatttttttaaagtttgttgtggaacaagtgtgtacggctgaagcctgaaagtgaagttatttgcttggaaatatttgttgcagagaataacagagaaaatgaattagctagcacctagcagaaggagttatttcgtatttcccaagctgagtaaagtggattggaattagttttgctatgccagtcaacatggattgatctcacattcagcaattccatggattaattgagagacaaaggacagatagctagcaaattgtggcatgtcatatattgtttgcaatagtatggccacttgtggcttgctagaacaaaggctattttcaagatcacagttatccaaatctgagtggagcttatttaaaaactaaggctgtggttttggttaaaatgaaatcatccgagatatcagtatcccaaatgtatgctggcatattgctagattataacattcatcttttcgttgattcggccattataacaacatggagatcattttatatgcatcaggggtaggtgtttagtgggggatggttatctaaaatatttttgtatagaaggcatttggttattcgttttcataatgtggaggatctgtttatggtacaacaggagaggttggctagctaggaacataaaggtgtccatttctaattttgagtatgactggtactccatgttttaatatagtatttatttttctatatatatatatataaaagaatgtctcatctactatcatcctagacataaataattatatcaaaatttcaagctgaatatgaattaattaagataaagttgtcttagttcacccttagaggtttgctcattcggatcacaaggatagagtttcctttacttggggagactagctagtcgtcatgtggctaattattgcaagcattccaaatttccctttgagttcaatgccatagcatcatcaccagattggtaaaccattcaagttggaagaccttaaaattgcgaatttacttaatgagactgttgaagcgaaaaaattgtaatgaactgtgtcatgtgtttcaaaatatacttgataggaatataacaatattgaatcgaacagtcctagaaatgtaattttgcattttggttgaaaagatgagtaatatatccagatagatttgctcagtccatcatttatcatgtggtgtttgaggaaaccgaggttgatgatcgttgtcagaatcttgccggagatttggtgtgcggaggcttcccaatgtggtcgatgagtagtatcactatcatgagatttggttttcaacaacctaattcagggaaaattctgtaattttaaagtaataataagatattctaattattgtctccttgtcagttgcaattactatgataaatgatgaactgagctaatctatgctatgatagtgtttttatgtttaaataataaaattaaaattttataaccaaagagtaatattgagcgtcattaaaaaaaaagttaggtggtgcaagtgtaatttaatcaagagtttattcttctttagttattcgcaaatttattaaattctgataatcttttatttaatgtatcatcttgtgagtaaccagtatatcattgaaaatcaaattgcaaaaattcattgttgagtcagtaagcattttgggtctggtttttgccaatgattacagataataaactggcgctagttttcagactttt

SEQ ID NO: 6090 - DNA, 1600 bp, Glycine max
  Soy_ogl_4120 Gm12:37350501..37352100 Cluster 27
aattatatattattgttgccagagtgaagaataaatctaggctaaaaatcatgatttgtgatgaagtaaatcagtttcttcaacaacaaaaaatattatatttaaaaaaagttctgaaaaatacaatataatgtaatttactcccacggtcaattatatattatgctttgtctatattttgcattttttttgtcttatatcattgaggcgttttggtgaaggaactgtgccataacgtggcttggttttattatgctcatttgtattacgcgctgtatgtggagtttgatgctatattgctagcagtcacggtcttgtattttgcctgagtacgtgttctctctcgtttagttgattgaggaatatgtggttgagtgcatgttaatgggctttttctgatatgtttacttggtctggttcatattataaaatcaatgtgcgcatattatctaatatgcatggcaggttctagtttaactcgcattcatgtgtgatgaatttttcctttgcatggaagtatttaacgagtaatgtttgtggacattcatatgtgatatatctatgaatactgacaaagaaaaagaaatagaagagataataaaatgggatattttgctttgaaaattactaaagtagctagtatacttgttaaaaagtttacgtgcacaaaaccaaagttttacacccattaaacatcattgccatatattaacacataactcaaaggatgtgtgtgcgtgggtcctaaatcttgaaaataacactatatagaggcagacacatccgctcatatacaatatatataaataataatcatcataattaagagataatttctcagtaattggagaacacttccaaaaatagcacttaaacgcttgaataacacagtagctccaggttagggctaaaagaccgatgcagctagccattttgtactccatgattaatattccaatgatcagcagccaatgaatttggggttccaagatgtataaaacgaactccatgcaagtaacgtgtccagcaacaataccacgaacttgaataatagaaaagtttacttgcgcttatgcggatcaaaacaattttgtaattggtgaaggtagctgcactaaccaaatcacacatccagcaatcaatagaagggaccaatgctgagggcaatcaaactgccgacaatcagcttcaattctatcacttcatcctccagtactgttcatataattgcatgtactggtcacagatcaattaaataccacaagctgtcatcataattaatcacattagccaatgcacttcaatccgtaaatgaagaactgaaattcaataaaaagtgaagtaattaataagagtcccctgctctgcccaagggattaatacaccagtttgcatatggaagaccacatgacagaacactcctgcaactaaaccaggcccaagaaatttatttgacatgttcaaaaaccctctctaaatctggttccacatcccgaaagataacctagctcgtttctttgaagccatagacaccaacatattgcacgccaaagtagctaggtgacgaaaccgtgctgcaaataatgattgcgcacctcag

SEQ ID NO: 6091 - DNA, 1400 bp, Glycine max
  Soy_ogl_5684 Gm17:14068201..14069600 Cluster 27
actactagaaattaatgtattaattgcctttcattattaatactagcctaacaaaaattttagtgacgaattttatgaaattacacgtaaattattttaacactaatattaatatttctgcagtgtacgagagagttaatatgtcaagtcaagattaatattcgggatcatatgatgtcagatcatatataataatttcttcatgagaggaaatattaggttacatttcttttattatctcactaaactaataattatcaaaaggtaacatgagtaattgtaccgttatttttcttttgtttaagacttagcttaattgttttaataaatataaattttcaatattgtttaaatatttatgttacatgaaagcattaaatatttgttaaagtcaatatttttcaatttgattttctattgatttaactcatataattcttccaattatctttttttcctattattttcaaatttgaatccatttattttaaattttcactcaatttatccttaagaaaatatttctgcaccattagaatagaggatattatctattttatgttagatttaattataaaattttcttattttcttttatttatattttagttttagataataaaatagaaaactgaattgaagttcaaattaataaagaaaaaaatgaccagaagagtagcccaactgcccaagatgaaatagaggtttgccatcattcaagcaagaaggcagtggtcacttctttcccacgttggacattgaaacatataaaaacagtcagcaaaagaggattatggatcttttggttcactttttttcccaattatcacctctctctctctctctacgagttttatgggtatgaaattaaagttcatgtctcttcaaagatttatggacttttgttatcatctctttttatatattttgtttactctttcattgtctagttaaaccttcaattcctttgttaagattgtatgaatttcaatttagtctttggatttcggaactgggttaataatgaaatttgattttttttcacgtttgtgttctctgtgtttaatgctttttaagacttttttttaatcaacaaagttgcaatatatttatatatgagtatagtacaaaagtgtgcccccaacccattttacatgtattattcatcactctagaaagaaaataccacccccactaccaggttacacaatattaacatcatataaatatagtgtaaccagggtgaatccaaaacaattttccacctgacatttatagccaccaaccagtcccaacataaatgctccctcaaccatccacatggttctgccaaaaacctagaaatcatgctttttaagacatttccaatctattttgtaaatcaaaatttgctttatgta

SEQ ID NO: 6092 - DNA, 1297 bp, Glycine max
  Soy_ogl_4310 Gm13:27618404..27619700 Cluster 27
aagcagacccaacaacaaaaaaataaacttcataccaaagtatatcaaggagtggaatttcaaaagcaaagaaaggtcaattttttatttttaaattaggatgaaatgaaaagcaatatgttaaatgttattattctattatctagcattcaattttatgatataacttttaagttaatgattgcaaaacaattttgcaggattatgcaatcacagcttaattttgatataacttttaaggtaatgattataaaaattataataaatatcatatatggtaatttatgtttgataacaatataaaattagagatattagatttgttgggtcatgggtgattaagaaagaatggaaaaagagaaagtctgtaaaaattttatttcatcacacttctcaccaatccaaaatggcataaaattaccttttaagattgtgtttggtttcaagagagaaataagttatcgaaaacgaaaatggagtgggtatgtttggatcgtgcgattttggagagaataaaattaatctttttctcttctcaattgctgtaatatcagtattttaggtcaaaaaattgatttttttttagcaaaaaaattgattttttggaacaaataaaaaaaatttacataaaaaagttgattttctttgacacaaaatattatttttcacctatttctcttaaaccaaaaaatgcaacatataattttatttctcttttttcaaattatatttcttttatttttatctatcattatttctctcctttggatcaaatgtttcagttctatttaattatttttccctgtttccttctgcaggattacggctagttcttgctgtgctctattccgctggtggaaagaaaagctgtttgtacttggctttttttgttgttggtcatagccttgcagtgcctttgccactgatacacttaaaatgagcaaacgtacaagattgaataaatgtgcaggtgttattttatttcaagttcttcggatactgtggttgacgtgaacaaggctacaaggcatgatagcatcttcgactgtcacgagactctcgccactgtgaaaaagtttcatcttaatttgaggatttttctggctttggatggcccttgttcctagcaccttctccaccatatgatgaacttgcttatgaaaaaaccatatgatgaacttattttattctagtttcaacaaattttgatatctcttacttttaattttaagacgtgtttcataattttgaagttttaaataaattttcattgttagagtgtgtttttatcttataa

SEQ ID NO: 6093 - DNA, 1700 bp, Glycine max
  Soy_ogl_586 Gm02:40084401..40086100 Cluster 27
taaaaatacttaaaggaaaattttcataaaaataaataattaagtcataaataaactaaacatggaaagtttaagctttttttatatatttaacaagtcaaattcaagattttaattgactcaatattaaataaatgagtcaagcccaaacaactcaatttttttcataagtttagactttaagtattatatttggctcgactgttttacagcagtacttacctttctttgtaacatatgtccacaagtaacttaatttaaacttaatatataatgttaaaacttaggactttatatgaaaattactaatccatcattttacattaaattgaatttattcaatgaagtaattataaatctcatttatttaataaaaattctttagtgtattattagtgtcttgacatattattgtcttctagttgttagtggtgaatatgatatcatacgagcctagctaaaattcaaagcagggagcaagatactttcaaaatgcagcataccaaagcaagcatgtctctgcaaatgccccttaaatcaatatgttattgtggaaagaccatgaaacataccgtatggtgctcaccaaatccttacttcagacctgttttttaaaaaaaaatgaaagaaaaatcattactcagaagcatcaaactgcattaccaattcaatatgatctagtcactacttgtttgtacaaaataacttccaaactcgtgatactttgaaactggacaaggtaggacaacgattgaaaaaactcatttagaaatgcagccctacttagaagtttctcatcatagattataaagttaaaatgacatttaaagccgattgaacaattcctcaagaccatcaagacaactcagcaaatatttatgcaaatgataatttggaaattttctggaaaaattcagctattagaatatcttgcatttttcacaaagttctagaaaattccaggctaaacgcaatctgttaagtcacagctccaaggaattacttttaatttgaaggttcatttctaaggacttcaggggccatccattgaggctgcattttgacagaacatatgcttgttagcaagagagagaaataaaacttcattaactaaaaacattttaaagattttactattactagttgttcgtgtatgatgttttgtatctaaaaagtgaaaagtgttgtcattacgatgcctctcctagattttttttagttaataaagttgcatccttcaacctagacaggccaaagtctccaacctgaaaaaaaaaaaagagaaaaaactctatattgaaccttcctaggactactgaatgataaacaatagcataagaacctccaagatagagtagaacataattatgtcagtaaacattagttgaaataagaatattcagaaacatttcaagttctaccaaaagaaagattcaggcagatcagttaaaacttttttgtcctaactatttcagaacttgagggaaactatttttcagtacttgtttatcacaattcatcacccattagacattgaagtttccttcaaagggattgagtttacatgtggcataaaggattctaagccattaatggattgagtttaaatgtcacaataatcaggtttaaaaatgaatgctcttttttactctagaaaatgataagatgatgcattcaaaattgacttgtatatatgcatt

SEQ ID NO: 6094 - DNA, 1100 bp, Glycine max
  Soy_ogl_1295 Gm04:35842501..35843600 Cluster 27
ttgatgtggaattttaattggaacctttgaaaatgaaagaaacacatttaacatttctagttaggatatatagagatagattttgtttcgataaaagaaaattaccatctagtgctatgtttcacaatccatccattcttttggaattatttttctaagatattttttatagtcaccatggtaaattttggaaaaagtagctcttttagcaaggggagtatcttcaagtctgtaataagaaaaaaaaggaagttctcaaaccaaaagaggatttcaaaggtctttacttaagccaaagtagacttttgggaaaagaggaaggcttttaggacagagtctagaaaatttggtattttctttatgatttattactctaccatttttttctattttttctctaatggcgaaattttcttctcgaaaagtggctataagaggcgagttggatgatagcatatacaatatacatttttgaatttttttaattttgagggcgagcttgtgcttaccgttgctcattttgctagtatcttgcatagaatcacgaaactttgttagtttgtctaagcaagaaacaacacaaatgggtctctgagaataatattttttttccaccagttgtggaaacctttggtgctaaggaagcaattttcaaaagcggatggctgaaattgaagcttcactttaggagtcccttttttatgaatgcagggataagaccttcatccccttaaagctggtaagggaaggttttctattgatgcaatgacactggaggcagctaatagagtccaaattgtcgtgcagacaattatctttgagagtaattccagcaaaaattatgttctgagggaggaatgcactccaaatttcgattaactctgattgttgaccaagggtctcacatagaaatatttgcttagtagtcgagtgttcaaaaaaggggctaagttacaatcaaaaagctcaacttgaagaaaagccttgatatatatttgctataacactcataagtgcaaaattccttactttgagctccttcgatcttaagttcaatgtcatctagaatattccttttgagggttatgttgttggccaaa

SEQ ID NO: 6095 - DNA, 1400 bp, Glycine max
  Soy_ogl_4037 Gm12:14313401..14314800 Cluster 27
ttaatcccaggcatgcatgggagccacgaccatgacgtatccttatccaagtgctacatattgctttattatcaaccactataatcggggttgaaagttttttgtcaaatcatgtaatcttttattaaagtctagagacagttgataaataattgaattcttcaaacatgttaatcagactttaatttttagtaatgtatataagaaagattttattaagaacgataaatctttttttttttttggtgattaatttctataatttgaaagagttagtttttgtttgtgaaatatacccttattgcatataaaaaaaatatatccttttttttaaaaaaaaattaatacttatcaccttggaatctgtaatttgtttcattttatttatggttgaaaaatttaaggaaatattattttttctaactttattcatttttttcatattaactaatagggcaagggttgttaaaaaaactaatagggcaaggaacagttatattttattttttctgtaaaaaaaagttatgctttatttaaaaaaaaaaaactcagcaatatatcgtatatagactagtagtctaaacttaaacaaaaatactgccccttaaaagatacatgtattttgtagcctaaaaaaatatcaaaagatacatttattttgtagccaaaaaaaatctctgatattttttttggcttaaataatcttagtccctataaaataaaataaaattattttatttctttaaagatttctcttttgattttatttcgtaaagattattttttgtttcagtctgtatcatatatcaataacaacgcaataatactgattgttcattaacttgtaagatcaaagagtcttatatgataattatgtgtatttttttactaataaaatgtgtttttaaatcttcatgaaataattgatttcagactgatgaaatatttaaaattacaatttaataagtcaatgaattgcaaacgtgattattatattattaattaacgttattacttgataataaatactaaaaaaaattaatcgactaaaaaacctttaaaagactaaaaaaacctatttaactttaagtctttttttttcttgtgtttaattttgtaatggcaattattttaaaataaaatataagatatatagaatcaaataattaaattttcatcaattcctttgtcgggtcacgactaaattcaaagaacgtggataatgcaattctcatcaaatcaagttattgatgataaaagcaaaaggacgcagcaaacttttaaggcaactgtttatgccaactatgtctttgactaaaccaattcaatctaatcaaattggatccgcatttccggaaacaaaattctcacatataaactataccgctccctaaacgttc

SEQ ID NO: 6096 - DNA, 1300 bp, Glycine max
  Soy_ogl_5691 Gm17:15333901..15335200 Cluster 27
gtgatggttaggaaattattaaaagttttaattttaaatttgtaagatattgtttaaatttaaaaggatattatcttttctttacaatgttatttagattcaaagatatatattatatgaggtgggaggattttattgagagatgggagatcatgtaagggaggatttatcaactttttccaaaatacttgtagtcagcgtggagggatggatccatgtagatgggtgtagatagggacaattgtccccacaaagttctttactaaaacatatttaataaaataaaataaaaaattaccccacatgaataaatagatgttattcacaacatttttttaaattgaaagcaaaaaattgtaaaagataaaagaagagaacaaattgatactaatttttaatcattttattcttctattttttaccattcccgcccctataaatttctaaaatgaaatgtgtaacagtgtaagatgaatatagaatggtttgtttgattacatatatagagaaatattttttgtagtaccaacaatgaaaggttacaagattttcaaaatatgaaaataggtagaagacaattaaattatagaaacttaagtaatttagattttttttttgtcatgaacttatgtattttataaaaaatttatagtattttttccttataaagatattataaattattctttttggttcccactgtaaaaaaattctagatctacactggtagtaaagttgtcgatgtaagcatatatggggtaaaaccacattaaaacaaatttgtgttgtataaacctgacggacggaatcaagttgaataaatttgtgttggagatgtaagtataagaaattaaactacattaaataaatttgtgatattttattttcttaagacactttttgtgtgtttttttattattgtgtgtgtgaagaagtatgtgtttttctccaacatgcagaggatcttttttctctcttttatgccaaaataattctcttattaaatatccttatataaagatattgttgtaattctaataccaaataattctcttagtttaataccacagctttttttcttattattgctatttctactattccaccaaagttagatatatagtagctaggcgcaatatattgaagagacagactgtcacaaaaccaagttgaggctcgagggaacaaattaaagttggtcttctggaaatatcaaaattttaatagtccatccttttcccattttaatacatcgaatcaagggtttttctttcccagaactggtaagacgtgacagaat

SEQ ID NO: 6097 - DNA, 2100 bp, Glycine max
  Soy_ogl_6069 Gm18:18882301..18884400 Cluster 27
tagaagaaaataattaatttgaaatgaatacctattttaggattatccagtttacgcaacacggcaatatggccatctgttaaatcaagaacatgaatgtaatcacgaacctgaaaaagaaaaaaaatcaggatattaatcaagtgtttgctgtatcagttacaaaatgtgttatttagttatgttgttaaaaatgtttattaattgttaatcacatctctaataagccctatgaatagagttcatatcatcaaattaatgggatatcgctgtggaagttttattttgttcttatgatgatttttggactggtcaacttaggtcacttgtatctcttctcaattttctagtatgtatagggtgtgtgtgagaattgcattaaatctttgaagggaaaagttcactaaagcaagtaaaaaaaaaagtgagaacatactccagtgtcgtcaattgttttataatcacttccggcttattcttttcaaccactttatagcattcataagctggataagctagcatagccaaaaaccatgctgccattacaccaaatgccaaataaaatcattaaatttcaaatattaaaatgcaaaccattcatataaaaaaactgaaaatttggaacaacaaacaaaaatacatacacaagggcccgggtcagaaaggatcctatcattttgtatccctgacattaaaaaaaaatggttactccaaacaacataacataagtaacattcaagcaacttcctacaattgaagaccaaatatcctccaattccacgctcattaaattgcatcatgacaatatcctaaagtccattttcctatttaaaaaaaaaaacatttttttgttaataagcaaatctaagtataacattctctaaatacatgcaagatagaatcctctaccatgatataaaagtatcaccaactctctcaaatattgtcaaaacagccaccaaaatcctgcaacacaccaagatcctgcaacacagaaaaagaaagttggtatcaatatttgtcacaagaagtcctcatgttaagttaagcacaaacaacaaatgtgtgtgtatgcaagtgcagagttccaagaacaatgataatcgtgagtaatgcactaaagctggttgatttgatttacaaatcgcaaatgaacaacaaaaataacatttaaaagcaaaagaaaaagaaagaaggaaacacttgaaggtgagtgtgttgcggtggagaaagagaaatgcgaatccgaaaggagaatttggcatataacaatatgaggacctaatatcaatttacaatacacttatacacatattatgttcagcaattcataagtcacaaacaaaatggaggtttcaggctttcatttactgaccattccaaataaagacatcataaccaaagctgccactatagataatccctctcctgataacgacgcctcagtcaaatctctcgggattttcctgttgacgaaaatcaacaaaaaccacataacaaaataatcaataaaattataaaaaagggaagcatgcattcacaaattactcataaaatttacatcgcaagcggtaatgtccataaaaaattataatgaatgtatgcctgtcataagagcataagcacattcctatgagtacgaaaaatataagcaaccaaaattttgatttcttaatatctacaaaagatgaaccacttcccaaaatgcatcctttttttaaggaacccaaagaaaccaaacatacaatagcaaagtggaaccttgaagtatcacaattctgggtataaggtttctaagtctattctatacatgccttgaaatgccatgtaagcatgtcatttgtaacatataagagaaagaaaaacatgataaaaatgacagaaaatgaaagaaaaaagagttaccttttgctgatattgcacctccagttgcacatccactcaacaaagcaacaatttattttctacacttgttttaaaaaattgaaatttagggataaacacttgttttaaaaaattgaaactttgagagtaaaaatgttgaatctcaagtatctatgaacattgaaagttacaaagtcaaaaaggaaagtaaagacc

SEQ ID NO: 6098 - DNA, 1800 bp, Glycine max
  Soy_ogl_6075 Gm18:20572301..20574100 Cluster 27
tatagccgccctatatgcacaccatattccagtgatttgagattgtttgttgtcatgtacaaatactactaagccactcatggtagaaagtatggtgcaattgagttatgatttctacatggacttgtgatattaattaatatcttttcttttctttggtccttaagagtgaagtatatgtgtacgtgaaggtcgattaatcttgacctgtgaaagcagtgccagattaattcaacgacaagttgagtcgtgctcaagttttgatggagagatctaaagatgtgtctgatggggatgcttttgttttcttttgcttttccttttctgggcaacatctggagatgggttgaggtgttggtagatgaggtttgcaatttttctacattgattaaatgtagaaatttttacattgattatacgtaatcgacgtagaaagcgtcctactcacgttagtgaatttacattgattttacagtcaatctagaattatagatacaatttacgtagaatacctcttttgcagtagaaagaagatatgatattctaccatgaactaacaattttgaaaaaaacattaagtttttaattcatgaattattttacgtaatatctctaacaaattccatctataatagcccttgagtgtaattaagtgcttgttgcaattgtttactatgttttatctgtgcaaaataatgtacgtaaaagaggggtgtgattttgcattcaaagagttgaaagcaagttataatggagaccgacagcctccaccatcgctaacataaataaagccataaatatgaagaaggcatgtgctatgtatttcgtttgcgttgtggacctcacatttttattgtcgtgcgctggttttggttgttgaaaacttgaattccactaggaatgtatcataatgaattatgggttgtgacaatatcaacagactacctacaaaaggtacgtaacattaatatatggaagtctaccttcattcaaaccaagcaattgatgacattctagtatgtctagtgcctttagttttcattcaaatttacactcacataattttcgtaacaaatattttctctttttaccttctttaactaatactctaaagacactaattaagaagaccctaaaaaagtatcatattactcaataataaagtagtattcaaatcattctatacaaacttcattcggttactctctctatttttttaaaagtgttgaatttttgaaaaaaaatgattttatttatctatcagtagcaaagtttaagatctcattaattattcttttattaattatatttttatttgttttctaatattcaataattttgtatgtacatttattgtggagtgagaagagaaaggagtaaaaaggaaactccaacttgatttcttgactatttgaaaaaaaaaaaatcccataacaacgcacataaaaaggatgtcaaaagaatcccataacaaagcacatacaaaggaacggtgggagtataaatataagaaaatgcctctggttaccaaacatttacgcagttaagtaaacttttaataagcattaaaaaagttatgggtgttttctaatgctttaacagcaaattctgcttgtatctcttttccgagaggcttttaagtctccttttgtaagaaaagaaaaagaaaaataaagttgatttaaacaatagctaaaaactgttcatgttcagctaaatatgctcatcctaatgaatgaaaaatgctgttcatttttcagagaatgatatacagttttattagtttaatattaaaaataa

SEQ ID NO: 6099 - DNA, 1500 bp, Glycine max
  Soy_ogl_6107 Gm18:48687501..48689000 Cluster 27
agagtttttttcccgctaagatagtttaggagagaggtgaatcactgtgagttaatggactatacattttccatttgtctattaggagttcggacaatagccttgtaagattacccttatataagcatttctctatgaaattgtggagatcctgaagagattttactaagaactagcagggtacacgtgtgattccacaggttatattgattttcatgcctgttttaaaatgacttatgtatatactaataagttgatatatattaaatttatcgatgtaatgtataaacataatttaatataatatattaaaataattatatatgaccagaacaatttgtatttgataaaataataatcatgctattttgattccattgcaataaagtttattatgccagtggtggaaaaaaaaaaagagaaggaaaagtcccctttattgtgtattgtagctttggacgaaaaaaattaaccacacaataatgatccgtggcagaggagagggagtaggaagagaactttaatgtgtagttagttaggaatgccatgcggttggtagaggtagtagtcaccacccacccggaaacctgttaagtagttattggtagatttttaaatatccacaaatatttgtgcgtatatagatggttatcaaaatcttaacttaatttgtgggtttactagtttacttatcttatgtgagttaatgcttgaataaactctttttagtagactatgtgtatagactttataaactcttagtctaggtggactctctcgaatttatcattaagcaataagttaaaaaaattaaatcaaaatataagttattttagattattttgtgtgtttagtattcaacctattttcatttagtatgttattcttaaatacaaaaattctcttataacatcaaattcttgatgggaatgatccaccattactataacatctgcaaattattatctagtaacaatgcattactagacttgattatttaagtattatgaaatttattattttactttattatattattaaaatgtttaattaatatgaatattttgttattatttttatatgaaatgaacttttatgaatttataagttgagtttacaaatcgaatatataaaactcttttaggtaaattcttagagtttaataacattggatatatgtgaatatgttaaaacaaaatcaaaataaataattttattaaaaaaacacttttattattatttttattattctaatattttttaaacaactatttttaatattttccaaaaaaatattcaaaaattctgtgatctccaaataaaattatttaaaaattctgcatattatgatactcgtcacgtcccggtctgttaccaaacggttattaaaaatatctatctgttatccgtgcgtactcattagaaatactcgtttactataccttgtagattttatttataaatatcccatgtgtagatttttgtgtcatccctggcagt

SEQ ID NO: 6100 - DNA, 1749 bp, Glycine max
  Soy_ogl_6124 Gm18:51078947..51080695 Cluster 27
aatatgcaaaatttgtatgattagagatgtaaaaatgaaaaaattacttcaatacaatggaattgggtgacatgcatagtatgtactgccctactatgccatcactacttattcgtagaaaaataaaatcataatagtatgccatattaatgaatttgttttgctgctaaattctctattggttcacttgtacccctaatcgtatgtttcaccagccttccagtctccgggtatgttattaataggaacaacccatgtttcttctccctcttcttcatcactaaacaacatccttaaagacaagggtccactcggtggagaggtagtagtccacactgccccatggcttctatccaggaacttgcacacaaagttttgagtctgcacacagtaaagaaattactgtcattaattgccattgctatgcactggcactgtttcccaatgttaaaggggttggttatctttaatgctttcccccaactaatagtactataaatttataattcaattgagattttgtacttgtaataaaagaaagggatagtttccaatggtttggtaaaaagctgggtgattgatctctagtgatttcaatatagcaagcaattgttatttagttgaaaatataatttagtaaacgttttacctacgtccttcctactaaaatgatcagattaaaaaattgagttaattctgtctaaaaatttaacaaaattgtaacttagttatcacaaaacaaaggagttaattgggagacagatagtacctcacagagctgcacaacaattatgtctctccttccttgttgataccaaatgacaaaagcaaagtaatatgggttgttgttgctctcatctatcttgattgttatgtttttatctgggtagttgcatgcaacactagagacagatagaaagataaaagcctcagttaagtaaaaaaaaaaggcaaatattgatgcaaaatgggttatatgatgatgagagtttttttatgttaccgtctatattgaaatcaatatcaagcacgccaagggctaatagagaagcagctgcatcagtggtttgagccatccggctaaaggcatgtttgccaagaatgaaatcagtgttatcacttgaagcttggtccgttataactgcagtcacaccattttctgagcaatatacactgttggtacacctcacctattgattattgaccaaagtccatagtataacttgagattaataaattagtttcaaactttagatacttttcatgagtgatgagtacagagagctgtttaagaattacttgtgtgaaccaaatggcagaaataatcccgtaataatataatatggcataatatggttatatatatggtgcgaagcttataattaagcatggttatatatatggtatgtctatccattagtgcataagattttgcatgtcgtgcaagctggtaggttaggtttcctcctttcaattctcaaaattacgtggcagaacttagtatgaaacaactccactgcatgcccataacacactgtgaagtgagagtcaatgtatgaccatgaagtgagagtcatattgttgataaaaggctttaaatacactgtgggtaatttctgtatggttttttttaaggttatcatttactactgctaattggcgttgctgtggaagctctttgattatagcaactccaggtacgtatgtacggtctactatctttatatgtattatgatagactactattt

SEQ ID NO: 6101 - DNA, 1935 bp, Glycine max
  Soy_ogl_6130 Gm18:51892201..51894135 Cluster 27
atgaagaatgtcttgcaaagacatatccacatggctagctagcaacttagcctatatgattatccaccataaatataagcacacagaaagtataactagtacaacatacatttatcaatgaaactgttcttgcttagtacgtagcttcatgtgcaggtatagcaattgcactgtttagtctcttttgatctcatcatcttagccaatatccatgaattttgacaagtcctccaattatagactatgatttttccaactctctggaggtaatgattttcaaattttaaaattgtgtccacaaacaaattaatcagataattggccaagaccgctaagtccaagaaatgcaaaattgcaaactactatagatcactttaaaacttaatcaagatttaagtttagcataagttggtgacattttctaatatatctaacgatgaaataatagtattcgattatttgatactccggagcagcaacaacgtgttcattacatagaatggacccacatgcttctttgagcagatatattcgatctatggctcctaactatccttagatgtttgtgcactttgtgacagttttctgttaacgcaatatgcaagacgttatacgatttttggtgtcagatcaattagcatgtgctgaataaactccttgatctctcagaacctgcaactgcaagtgtgtgtatatagatagatagaatgatcaacgtttcttaaggacaaaaataagttataactttttaagtacttttaacttttttaatcaaaattagagtttctacctcaatctgtataacaaaagtttatattaaaaatcaatataaattattgaattgaatcgatatcttcaaattaaaaaatatatataatcgcataataatgtaattgctcattgcggtagtgatattcaaactagaaacggaacacgttactagccactgtttactataatgagatttgtttttttataataagagtataatatatatgctatgccaaattaaattataaggaatgatatttcataaagttattgctaattccggtagtgatatttaaactatagggtaagagaacacgttactagcactatttactaaatttagatttgtttagaatatatatactatatagcatatgttattgccaagttatatattctaaggaatatatatttaatgatggaatcattgaacgtggtcaaactaaggtgggaacaggagtcctgaacttatataacagatggtatagaaaggggacagggttagggggcatgcacgcgttaattattttgcacgttagtggagaaaacaagggaaatgaagggaaaggttagtgggttgggatgacccacatggaaacgctagctgaatgaaccttttgagaatcatttggttgtgtgtgactagaaagaaatagaacctctctctttcacagaggcaaatcatcaaacactttattcgtgtaaacgggtttagcgaaccctgtcaagcttgttgttgttaattgttgccaagatgtggctgcacctttttcggcgtgctgctagggctgagcgttggagcctttgtttccctagcgtccccatttcagtaaccctgttggttccccaactctcatgcagaaacattactcggggcaaagtttctatatataattttattgatttatttaagattaatagtatgtaaacttaagaaatgcatttaataatttcattctattttaaacctgtcatggtgaacctctcgagatcatttgggttcattttggcaaattaggtctgtgtgatctcgcagtacttgaaatctaataactatgctcattgcggtatatatagtacatataaatatttttgttactaatgacaatttttgtcactaatactaatgtcactaaaatttcaatgatgaatttttaaattagc

SEQ ID NO: 6102 - DNA, 1100 bp, Glycine max
  Soy_ogl_6408 Gm19:37129301..37130400 Cluster 27
aactatgttccgtcccatcaacatctctaagaaattcaggctccttagtggtaaccatgaagtccatcaagttgcggctgaaccccaaatcagaatacaccctcaaggcatcctagatatgaaaatagatactactagatatagcagtggcagaacattaaaaaaactgatatattgaataatatcacaataaagcacccatatatatgttcatatcctctactgtcaaatcagacaaagaactcatatgactgtgtctcattccttatgcagtagccataaagccaaatgaaaacaagctaagactaaggcctaatgatttaaaaaaataatacattaaagtacatgcttcctttacttattttgacagtctcatgctatcatatataaacatattatgtataaacataatattttgacagtctcatgcttccttcattttttattttccattcagctacacgtgttttatttttgtatccttatacaaattaaaggaattgtaattaaaaatgtatgtgcctggtaaaataattgttgcaatggcatgttgaagagttatacagtatcagaggcaaagaagttaacatagacaatcaaaggcttgagaagggagattatagtgaagtcaaatgaatcactgcagcccaggtctaattctaattcttaattatgtcagggagattatagtgaagtcaaaggaatcactgcagcacatgttaaaaattgtgttattataaatttattaatatttataaaattaagttaaaatttaaaatgatacgtatcataatttgtgattagcaagtactttatattatcagtagatcacctttaaattcatatttatatttaaaaaacgacctaagtagattaacaaaattagatattgaagtaaaattgtaattaaaaaaataccacataatttaaaagttacattttaaattacttgtttagctgttattccttatggttcgagtaataataacgataacaattcagcctgaattgtttcagattaattttcttttttgcaaaaaacaaatacgggaacgagcaacaatttgaaggttgtacattcaggaactaaagaattcaaa

SEQ ID NO: 6103 - DNA, 1600 bp, Glycine max
  Soy_ogl_6696 Gm20:2495201..2496800 Cluster 27
aagaagataaaaaaggacatatcattgccctacctaattcacctgtctaagacatcttttttggcccctcctcaaggccttcaatcattctattcgttgcacggcgctactcttcaatagtgacggtacttaggttgcttcaaacttgcatgtgactagcaaaattattgtcacgaattcaaactttttaatgttggtttatttaatcatttggttcttatatatgtgtcaatttttcgttttattatcaccctataaactatagtcctcatatatgacaaaaaaataatttatagtttagtccttactatttttctaacaatataaaatcgtcacaaaatgaaaacatcaaaacgaaaaatgtagaatttgtaggtataatgactaaaacgaaaagttagcgcaagtataagtactaaataattaattaaatctttaatatttgaggatttttttttcctttatgcatgtaataggaataaattgagtttaactcaacataagaaggaagctcaaggtttaggatcttaattaaggtttgaggtttaaaatatcactttatcttaaaatggattaatgtagtggaagagatcatagaaattaattaggtgttaaataaaagtttcagataatttctatatacactaaaaaaaaacaactcaattttgaattttttaatagcaatatcgaaattaaaaatgagacactgaaaaaaaattgtccaaattttatatcagcttctttgattatatttcttgtcggtataaaacatttcaatggtatgttcgagaacgaggaagttctcatttatttcaaaaagtaggctactacatgaatcacaacttccattcctttatgtgaacatgatcaaagaaaactttgcctcacagggtatcttttagagtctatgttaaattagaggaaaattttatttcttagtattcaaaatacactcaattaaataataggaagcatgctgagtgaccttgttctgctcacttgatagttcgtatcaacggcggcttgaagtctctagtaactattttcttatgacttagtaaatcaaagctcaatttgtaggattataatggcctgcaatataaatattttattaatcatttctatatatctaacttgtcgatctcaatactcgtcaaagaaaaccgcattgcattatttccgtattgtcgcatgtctatcatgttgctccatatcaaaaagtaaactacttttcgaatgattcaatagcaaaaataatatacaattatatattaaattacaattaataacctacgtacgtatatagttttgccggtatatgttattactgctcgtagaatgaaaacttctagaggaatccattttagcatcttttcatgtatttttttattatatcagtattattgtacttcaggaaaaatttagccatgcatattatttctaattactcaaatacaattatcttttgttattactctatgtattatgaataaattttttaaaacaaaagtcttcattgtaatactaactgttattaatatacatatttgctatgttttcattaaaaaatatttataaataaatttcttatacatagttt

SEQ ID NO: 6104 - DNA, 1200 bp, Glycine max
  Soy_ogl_4767 Gm14:43307001..43308200 Cluster 27
aagattcttgcctcttgtttttatgtgacactgaaaatggtggatttcactcgtttttattagatacggtttgtgtttgggaccatccattattcaaatgaaatcagagatgagattttatctgaaccattttgtccagactctgcccctaccctgtctctctgagtgttgtcggtgtcggtttctaaacagtctccattaccctgaaattgcacaccatatataccaacatacataagtactatttattagtgatttgcctacgaataccaacaggtactggacaacaaaaccatacatgtctaattaaaatccatgttagtacattaatttttggatcatcatgtatttaaattacttggttcatttgtgaaagattaaaaatctaaaacgccacatttgctcaaatgttgcacacgaaattgcctaaaagaagatgtgactaaaacttcaatttattttataaaaactagtttaaaaagagacacttcgtgtctcaatttttattagaaaaagtggaatagttacatgattcatgaaagaaataaaaacatttatatatcaaagataatttagaaataagaaatatgtacacagaaaaatacttttattaataattatagataaaaaattatatgaaattaatttacattgagactaatcaatcatcactctatttgtttagatttgtttataagtatttataattttagaagaagaaataagaaaaaaaaactaaatttaacttatgcataaattaatttgtaaaagttttctcgtgatagtttcttttcaaaagttagttttaagttacgcttaaaatttaatttttccttataatttttttttttttacttttttctcatataaatgtttatgaaaaagttttgtcaaacctatgtgtaaaaaaaatagataaagtgtgtgtgtctgtaatgtcaatcaaaattttattaaacataagcacacgcagatttttataagcatattatcattaaactaggcaacatgtggttcataatttaaactagtaaaacttaattcataaggtataccgaacttgagcatatgtaccatgcagcatgaacttgttgaattcattcaatcgcacaaggaaaacggaagtcaaatcattttcaatgctagagccaggttaagatcttgagcgtatgaaactcaaatttccaattagttttcgcc

SEQ ID NO: 6105 - DNA, 1302 bp, Glycine max
  Soy_ogl_5999 Gm18:8720500..8721801 Cluster 27
caaaccattagacgagagaaaattttaatgacaaaaataattttaaaaaatattataaatgtaagacaaaaattattattatgaattaaattagtcactttctttaatcataactagtatgcaacccgtgcatacgcacgggttgcttgattaaggcaaaattccaaagtttgatattcatctcataagagataatatgatcagaattatccagactgtaatgcaaattaatttggcattgatatgaagcatcgaagaaaggttaactacttatatactattatctacaactaattaacttgtccagcatgataagaactcatgaaataacgttaatttcatagtagtttcactttctagacaacaatgcaattacaaaagggttcttttatagctatcatgcagctactcgaggacgcaaattctggtgatgtcaatgtaacactgagtgaattcttggtctcctggaaagatcagtggggtaactaatggaatgaatgaaacagaaagtgttaaaaggcaaacaacagaagtgtatgtcagcactaaataagggattggtatagacacaacagaaagaaatccacggtaatctatcttgtaagtttaggaacagaaacattacttatctatgtttcatgatttaatcatgaggttcaaacataataaagaaaataaatgtttaaaactaaaaggggttaaaaagaaaaaagaaagtgtagtcaaattgagaattgaaattttaaataagtcaaatagttttttttttatatataaacacatgacatcatgtcaattataatacaaattactccatatttacatttgtcaggtcacataataataagttgattgttaatttactgttaaacaacttaaatttaaaagagaatgcaaaagaataggactgaccaccatccctatgacatttttctcattgccattcaaactaagaaactatagaagaataaagactacataataataataataattcatgaaaaaattttaaaaaaattaaattcaagtaaaaatgagagaaacactaacgtcttaaaatcctgtagttgtcctgacctatgcatggtggagagaagggatcacaaaagagataatggcatgtatgtctgtcatttgtaacatataaaagaaagaaaaacatgataaaaatgacataaaatgaaagaaaaaatagttatcttttagtgatattgcacctcccgttacacattcactcaagaaagtaacaatttattttctgattaaaaaacaaactaagaaactatagaaaaataaagacta

SEQ ID NO: 6106 - DNA, 1200 bp, Glycine max
  Soy_ogl_2371 Gm07:19879701..19880900 Cluster 27
caaataattaaaagagttctttggtgattctttggtgcctgattcagcctgaaaaataataagactttcgtcaatcaacattataaagaattaaattgcaagtggctgactaatgtttgcttctataatttcttctcaattgtaaggttctttgcaagtggctgactaatgtttgcttctataatttcttctcaattgtaaggttcttccccagttttaataacaggccttgctgtatatgtataattttttttaacaataaacctatccaccacatttaatgatatgataaattgggaataattttttttaacaataaacctatccaccacatttaatgatatgataaattgggaaatacgtaggggcacacatgctacttgacaaatatagatacactgatagacccgctgagatatgttctaaagttagactaatgacttgaatatatgaaaggactaataaagaataaactgaaccaataccaaaaaaactgcaaatataaactgtaactactaaaaactagtcagagaggttttgatttttgtaaataaaaagaatttactcagacaacgccattttacaatactatttcaagcggctaaataacactgttgtaaataatgtcatgtgtgaacttaattttgaacgtaataataatggtacaaacttgtgaatggaatgtctattactgatagtgtgtaatgttattatataatttgagtataagtgaatatcactttactagttcaactactaattgtgtaacttttataattttttagcatataatgtaatataaattacttaatttatatctataaatttcataatagtggttattccactatctactatcctactataccagttatggggtcaaatgctctgcatcagtattgagggtggtttttcatgccatcatcaatttacaagaatattaattgatttaattggagtctttgtacataattacctaatacttatttactgataagcatctttctctttttgcagaaaaaagactatgacattgcccttgttggggcctttagaagggaaaaggacaaagacatggaattacaggcactaagagatgaaattcaagcgtccatgaagctggtatctttgaaaagccatatatttcttattgttttgttatcagttttgaatgattgattaatgagggagagaataaac

SEQ ID NO: 6107 - DNA, 1222 bp, Glycine max
  Soy_ogl_3116 Gm09:35744379..35745600 Cluster 27
tacaactcaaaatcttacgattttcgttccttttacatttttttttgttttctaataaccatattcacttggattatattaaaacagggcggctaagcatttatttgtttcttaatcgtaatgttccacaccatactctttggaagatgattatcctaatgtgctatttaattgaccatttatttgcatatattaaaattcaaacgaatcttttatacattattaaagtttaggcgttataattttcatcttcttattttttaaaatctattattttagtttttttattttttaaattagacatgtgatccaatactttttaaaaagttggcaattttagggttgtattttttaattgaaatattttatttatcattttaaaaaaatctataaccactacaaaaaaaaagaagaattactggccgtttatttgtggcagctgttaaaaccgccagaaaatatcaaggcatatgaataatgtccttgggtttcctaagttcaatacacacaaattttggcaaagaagatagaagaccaacttgtaaagcacctgataaaggttaaaatatagaattagtaattactttaacattttgtagtaatatgagtcattgttgttaactgctgaattatttgtattagtcagatgaaaacagtatccatttatgcaggtgttgaaccatggtattagctctcaactacagagagagatccttgacatgttggaccacccttttcctctagcattatatgcttcctttcaggtttgaaactccagtgcacttcaaagttaaataaataaatatttcgttctaaactttgtaaccttttaattcactttattaaggtgcctagcgatggagattgaaattaaacattatatttttttttctctagagaatcaagcattataaatgatatagtcacaattcagaatttggtcagccaaatgcaatggcttcaaaatagaaatacgtaaaccacttttaatttatgttatactcttgttaaatataattgtagcaagctttctgtcttgagcttcctcttgcattaatctaccagaaagaagtgaggagttaaaagaaaaatgaaattaattatattggaaagtcagaaaaataaattttttagaaaaggacattcatgaaacaaccttcatgaattgaaaaaaaaaaaagaaatagtgagaatgactccaaatattatggaaatagaatga

SEQ ID NO: 6108 - DNA, 1000 bp, Glycine max
  Soy_ogl_5344 Gm16:8086701..8087700 Cluster 27
tttttaaaagttgaaggactaaattagttcatttaaaattacaaagactaaaatcaagtttaacaaaaaatatatataggaaataaaatcatatttttttcctataactatgatttcacccaaaacaaaataattattattttcgtttcaaaacaagtgtcatattttttttaaaaaaattatttgtattaaaataagtttcatgttacttttttaatgtaaaatgaattgctttttattttcactaataaccctaataaataccactttacctttttaatgtaatattgataataaaattagttttataaaattattatgctctttcattaatttattagctttacgtgatttgtgtaaaataacttaaaaatacgttaattttaagatagaaggaatatataattatgttattttgaaatttgagtatatacatatttcttactatattggccccaaaaaaagtatggccaaattctgccactgctctaatccaggaaaaaaaaatcaataatattaataatagtatacattttatattaagttaattgagtcggtctaagatacatgtatatattttttcataagtattctcttctttgaaagtaatcttgtttaagacactcaaacactaaataaccaccccttttagcgtgcactcaaattcttagttcaccatattatatgaaattagtcctttctgctttgacttaattttcattggtagatacacacattttgacacccttaacttcagctaagtcagtgaacctctctttctagaggggcctccacccattggtccaatgggcacacgatgtcaagccatcatatgtggtctagattactttgtaggtggttgctgtactagctacacaattcttcatcactagttaatttgaattgtgtttttacagtggatgcgggccagcatgaacagtttgatgcacataattgatgctctcttatttgaaagataaattgctttcaagcatccatg

SEQ ID NO: 6109 - DNA, 1320 bp, Glycine max
  Soy_ogl_6081 Gm18:23148401..23149720 Cluster 27
ttaaagttgcatcattaaaaataaaagttaaaattgtccaaattaaattaaagaaattaagtaactataccattaaaggcattctaattctgtatttccatttatatatagatataagtttcggtagcacaactgcacaaaagacgaccatataagactctgacagttggacaatatatgtcgcaccaggggaatgttttgatttttatggttgtgtgtgtttttttgcagtcacgtgaatgatcctttgaactggccccactttcaggctcacatatactgacatatatgaactatatatcagtcaagaaatgctagatttgtcatgtgatgtggccggattaatttaccgatatatttcaaaaatgatgttgtagtcgtacctgaaccagattcctaaaaaaagaaaataattcttgaaataacaattttataattcaaaaatgatgttgtagttctttatagcaactgatgtagaatgttgaagctatttgcaacttcgagtataagaattaatatttctaacatttttgtagatcagttctttattatgaaagtattttggtagattggttctagatcggttacataaattgagtctatttctaacgttttttaagcacaaaggaccgaattgataaaagaaaacaaatgaaagaggaaacaaaagccatgacagggcaaaaccaagccaagcaagaaaaagcagaacataacctaaacctgaaaaggatatagcttgtctatcttgtacaaaaagaaggcaggattatcaaaagcacaaaaatgctgtaagaccagcctagtgtcaaggttgtttctttccaaccgaaaaatggttggcaatcttgttggaggatgaagctttttgcttagcattcatctttttcttgtttcccttggaaatgacagtggagaactcctcttccctagtctcttccatgtcttccacattatctgcctaaaatttaaagagcaacttgaaatcttgttgtacttggacatgccaaagatttaaattttccatagttgtggaattttctggaatatgaccagtttgcagttgaggacactcctcagcttgggctgcttgagaatcaacaataaaactgggagttacaaaatgactatcaaagtcaccgttgacatcttctaaggcataatgacgataacatttttatacaaatgaaaatgaaaaaacttaaaattacacgatctcaattgttatctttaattagagtgtgtttggttaaagtaatttaaaaggagaaagtacttttacgggaatttaaatttctgtattaaaattatttgtttggc

SEQ ID NO: 6110 - DNA, 1000 bp, Glycine max
  Soy_ogl_6374 Gm19:13511501..13512500 Cluster 27
cactgccaaatactcttcgtatatacgcctatataattccagaatctcaagaacctgaagcagtatagtttagaatattttgaaaacaaatttccaaaagatgggacatcagcctgcttaggtggaaggaaaatacaaagtaacatgcagatagtatgtgcctaaagcaaaagggaagatcataactaacttaagtactatagaaccccaagaaagggaagatagtgatttacttgattttttggtattgaacttatatagtgatcctcatccttgaaactttggggctttctcttagaaccacatgctgctaaaactcaagtaacagaataagaaattaatcattacactttttctttttctttaagtctttcactctaaatcctaataaagcatacacaagtaaaactaaaccttgaaattttctatcaattttaactgacaattcttacaatgacccaatcttaactgctaagaaagaggtaataaggttgaggcactatgttctttcagctgtgacactagaaaggcacatgcttgataaaaacatgtgaagccaaggtcaagtagaacgagtttccatcttctaaaatcccgtatattaaactattatctgccgtagttataaaaatgaatttacagttataggtagtaatttctagtgactatccttagaggatataaggtcaactaatatagtgaaagcaagcaattaacacaaccatcagacaactctgccaaccttgttattaagatatttgatagttcctttatttgtcattaatcaattatatacaacagtaatcttcaattattatattcaatagaaatctttttcccctttcttttgatatttctcttttgctaaagcctatgacacgttctttaagtatagaaatcaccttaaccacatttctacatcttcggttgaaatagaaactagactaaccatgattaacaaataacataaaaccaagcataataacttgaaacaagggta

SEQ ID NO: 6111 - DNA, 1300 bp, Glycine max
  Soy_ogl_6062 Gm18:18540101..18541400 Cluster 27
ctatttgtttactttacttccttcataacaagaatataatatgtgttgagtacttgcacgatggttaaaaccgaagtggatgtgtgatgttcttaaaacattaggtagaacacaagaaagatatttgatttgagactaacttatttagtttctttataagctgtggattggagctcatatagtataggaaggactttttcaagtcccgtgtttcattgcatttgtagtataatatataagaagtgacatgcatgaattttcaaggcttatcctctcgcgtctcaatgcagcgaaaaccaaaagctctgcaatctccctagaattatgtgtgatatggaaagagatgcagatcaatccctctttcccaatcaacaagacaaagacttgacaagataaaataatatgtattttggtaatcaagccaacaaaatatctagataatattttttaataaaagcaagtggattaattttattaaaaaatgtacactcttattctactattttttttttttacttttttccgatccagcaaagtaagtagataaatttatgcttaattaattatgaacattttttaataatatcaggtaggtttgctttaacaaaataaaagtaagtaaataaatttatatttaatttagaaggatatattttttacacttaactaatttgatataactttttttacacttaatcaactggatatattttttaatgcatataggtgtaaatttattcaaaaaaatttaacataatatttgacacacaagaattttttataaaataaaagcagcacgtgattttttttatataaaataaaagcgaataaacttagtcctattttaaaaaactcactcttctttttcctctctctctctctatatatgcgcttaagtttatttaaacaaaatttatggataatacatgatacaatggaataaagaattagtacactaagttgaatttaacaataatgataagcaccactaagtacaagtatttgtgaaactatacttgcattttaaaagtatatccagttccatttgtattatctcttgatgataaaaaaatattcaaataaaaaaaattataccttcttttttgagttgataatttcatactgtaattttattattatatttaattaatttgtttagaaagcattccaattctgggacatccaatttgctacagaaccaagcaacgatttcacccacaaatgctacttcatcaacttttagccataacaatcacaaaaacactcaatcaagtacaagctagaatcaatttcagagaaa

SEQ ID NO: 6112 - DNA, 1130 bp, Glycine max
  Soy_ogl_6490 Gm19:41485101..41486230 Cluster 27
taaaaaaaaaaatcaatgtcaacgattcaacaaaaaaatctcggcaagttttcaattttaatattactccatattatatatctggatacagtcaagtttagggtgaggggttatagtctcatctttaatatatattttgacatttttttaatgttttcacataccacatcattacactgtgtcaccaacacatcaacatatcggtaccatatgcggcattaaacgtgtaagattttattatggtctaatcattctattaacttttatctgaattcttctgtcctaaattattaaacttaaaaacttaataacccataacttttatgtgaattcttttgccctaaattgttaagcttaaaaatttaataaccctataaatttaacttagtcatacaaaatcttgttgtgtttacacctaagaaaataatttacttgtagatagaatttgtattcaattttttttttgtaaaattttattggatcattgacaatcatatcatgagtgaaattagaaatttggaggacagatatttaataataaaaaaaaaaacttaaacaacttagtttgttgagattcaaggcttatgtaaagaagaaaaaaaaaactttattaggacaaattatttcattgttacaaatgtttttgactcaaacatattaacttttgtaaaagatactagtggtgtgaaaaaaaaatgtatattggtggagcagaaaaaaaaagtataattcattgctgatttctcagctatgttgtttgctcagctgcttgccattgtccttttagtctgtgtactacacccatccattcaaaccaaagagtactacctcatttgaattttctaaatgattagattttcttaaggttttgaggggaagaacgagatgaatattaattgttgaaggataatgtaattctatatatcaacggtgtcgacctatttaataaggagttacctgtctagttgtgtttaatgtttctgttgcaccaacaattgtcgccagattcacatgtcgatagttataactatgaaacgaattcaacaagccacgttatatatcctgaatcaacagtaaaatgaggtggtcggggaggggagaggacatatgaaattcaatttattatacac

SEQ ID NO: 6113 - DNA, 1021 bp, Glycine max
  Soy_ogl_5640 Gm17:11997601..11998621 Cluster 27
tgagcaattataaagaatagatggttagttgtctcctcctcatgaaagcaaaataagccagagtaattattatcaagtatattcactcttctcttcctcagattagcttttgtctgaacatgtaaatcacgtttaaggatagagacgtatgcaattgactgaacaatgtatgttttattgtttacaagtaaatgcattttcttggtgatgatgatgatacaaagttgacattattttatattctcatattttaaatttggagtaggttgggttactcatactagaaagttttatttcccagaatgacaactgttgttccaagttaacagccagatgcgacatgcattagagtaaagttgtttttatcattacactaagacagtaatattgtttacaagaggcattcgatctatgccggtaaattccacccaattaggttctggagttccaccccaaacgcaccccaaaatgcattaataatcagagaacaaggaacacaaaagatcaaatggagagactataggccaaaacccattgaagaagctagcaaatctgaattctgggagaatatttttattcctaagaaactcattcctaacaaaagaaggaatcgagtcccatcattggaagtttaaaccagaagtagtcccatgattaactagcttgtccgtccaagaattttttttccctataaatatgagagtagctttaagtaacccttaaaaaaaaaaaagaaaaaaaagagagcagcttttgcatgtacacatattcatatatcatagccagcgatttagctcggacatgtctgcagtctaccttgaattcattatccacatgaatcttagatagatcaatacatgatttatatatttttaatttgacttgaaatatggttttagttacttaaatttgagttatttttgtttttgttttccattttttttagtctattaattttgaaaatgttcttttagtttcttataactgatttttggaggtttatatgcataatttatgatgt

SEQ ID NO: 6114 - DNA, 1000 bp, Glycine max
  Soy_ogl_5965 Gm18:6594801..6595800 Cluster 27
aattattagaatgtacaaagttgtctataattttttttatattcttgtaagatctttacaataaatattttcttatttttattatttaatcaatgttctaagatgatttgtttgctaacaacatccttttactttttgctcattctaataaatgatgaagtaattttgacatgagttttagggatgtgcatggttatcaccataagcaagtcaaccttgtgctcaatgcaaagattctgtcaatcccgagctcatcagacatgcaagcatgccacgataaatgagttaccttaaattcttaaaaccatctccttgttgtttgttgctgcacactattcaaagtttactccttttttaaaaaaaaaataaaaaaatctttcacattttttttcttttttagttatgcaagaggagcaaaactatttccttctataaatcttactactactatattataagaaaaatattaaaagaaaagtaattacatttgacgtattaaaaatataaaaatcattcaatattttttttttaaaaatttagtagtaactaggaagattcagaattatttatttaaagggagtatgaacaatattttgtgcaagtattttcttgtactagttgtcatcactgatcatcattgtttaaccacatatattgtagtatactactatattattgtagggacagactcatcggattctcccaatgttcaaataaaaagtgaagggacgcaaagcattttataatcccatgtttaatggccattatttttagtgttttcttaatacttttttattttaagttctacgttgttttgtgtactaatagccaatcattctttttaaaatttgtgatatctgaattcatatatatattttgaaaacattgacagctatctttataaaataccttaaaaaatacttttctatataaaaaaaattgaaacaaaggtatcttgtgtaatggtgcgtggatgctgatgcatctagaatttgagcca

SEQ ID NO: 6115 - DNA, 1554 bp, Glycine max
  Soy_ogl_6142 Gm18:52640847..52642400 Cluster 27
tttactttctcatgttagatacaatcagactctaaaggatcttcgtaacaagcaagtccaggtctgggagtgttgttttgacaattccgtggatataatgtttttatcgtttgcatatggttgtagactacacatcataaattatcatcatgttaaaattaaagttgaatctttggatagtatttaagtttgatttttaataaaaattattattagtaaaaatttacctatcgaattttatattagtctgatttttttttctaattaaagaaaaaaaaaactacatgctgctaaaaaaatgactcaaactgaatcggtgggtcctttttcccttgcttcagaacaattttccgtccatgcactatgaacattttattttaacttttaaagcctatgtacgtaattaagttctcaaatcccattctttacaaattttagaagtccttttgacaatcttaatttgttaaatttaatataatttttcccccaaatctttcaatgcttggtaaattgagaatggtttgttatctttgttttcatgtgctatcaaatggtatggtaaagtatcttagatgtaactatatttgcacgcgcaagtttctcgataactttgtgggattgcggaaaacgtttcaatatgttcttaactttggtttaatcaattccatatgcctttatggcaccttcaggtatcatttctgaaattgaatctatgtttaacatattttgtgggatggtcaagaagggaaaataatggtgtagagggttgcaattgggaattgggtgtatgtttgtagagaaaaagaggtaggagggctaggaattaaagatttaagggctttaaatttagtcctattggaagagggtctatctggtggcaggatatttggcatttggatgaggatggtaaaggggatgtaggtcatggtttaaggaggttgtgaaaaggttgtgattcattttcttttatatattagaattgaacataaatataaaaaatttataataatttatatatcatatttaatcaatggaggtgatctccttgatttgatacattttttaatcatatgtttgggtgaagggaggagctagtcgagatcaatttccaagtttttttcattggcaactttaaaaaattttacagcaatggatagtaattggtgttgtagtagaaaacttttccaatggaaagaagaacctttgaatgaattacgtacataggagtctattattttttggggagtttaggagaaggtaaagatgaatggaggtgaaaatatgagattagtggatcctatatagtgcgctcagcatgtttaaatattcatacagagatatttgataatattattattttactattttaatttattcattaatatgatatgataatgagacgaattcttatttaatatctacgcagtatataaattaagaatttaatttaagtatataactttttacacaaacttattcaatgagaactcattccattatcacatcataatctgtaacaacatcattacatgacttcatttgaacatgtgatgt

SEQ ID NO: 6116 - DNA, 1200 bp, Glycine max
  Soy_ogl_2859 Gm08:41863601..41864800 Cluster 27
atcagtaaaggataatctaaatcttaaataaagcaacaaaaaatgttattttattaaagtcgatcacaaccgtaaaataaaatagtaatataaactgcacccatacatccaattatatatatactggaaaaaagtaaaattgttttatgaactacagaaaacattaacaatattttgtctagatttacaactaattaagtggttttcacatgtactataatatactccgccttattattttttttcttttttactcaaattacgtactaatgaaccaaatttgaaatgagaacgagaaaataaaataaggagtgttgaacttgaaaagagccaaaaacaattttatctttattgttgaaatatttaatgtaatttttaacttgatggaattagagattgtaaccacgagggttgggtctagtgaaataaattaacctctcataatatgatgaatcaagatttaaatctttattaaaaaaatcatttaaaattcaattgtcttgaacaacattatctgtacttatgccggaatgtttttgaacaacgatgcacatatgtttttatctccatattcctagattggcattcacaatatcacattgatcttctatcatctcagttgtttttaaaatacaatagaacgataacttagaaaatatatcaaacaaagaaactacacatgagaataagggaagtgttttcaacaataaagataaacaataaaatgttgtccttttttgtgacgtgtttatatatatatataaagtaaaagaaagtcaaaaacagttatatataatatcacatgtgatgtcaagtttttcatattcaaacaacggaacttttgaggacaaaattaaaaacttcttgtagctttttttttttttggtagagacccatttttttggaacagttctctgtagctttatctccatataaaagtaaatactatttgtacacgcaacgccccggcaacaacaacataggatttcatcacggctgtgttgtggtgttgagttgaagttgaaggtgctgtgaatcatataatatgtgcaatgagatcaatatagtcaacctgacaataactaaaatttagaaacttttttctatttcatagagaaaagatcaatatctagtcctatagctagctatacataattcaggcttatgcttatttctttctgaacttgttattacttagcc

SEQ ID NO: 6117 - DNA, 1200 bp, Glycine max
  Soy_ogl_874 Gm03:33657801..33659000 Cluster 27
tctccatgcttcttaaggaatgaagcacacttgttagaaaagccaaaattcctaaatagatcctgcatcataaaagaaaacgaaaagcgattaatacttactaatattgtcccgcaaaactgctgtgttacattaaaaaataactaaaatatgtctgtaatttctcaaattttagagaaatttaattttagtctccaaatttaaaattgatatttttagccctgtaatttgaaaaataaaaaaacttattttagatctactcaaatgacctatgcataaacgccacccacatgactacttttttttttaataaaaaaaaaacatgtaataggatgtttggtaataagaatgtaaaatcaaaatcagttgtcatgtaaaaaactcataattcattagtcatgtaaggaaaatctctaatgatatttgggtggaggctagggactaaatggtttattctccatcaatttaactgtgttccaaaacttatataataaactgactccttatgcttccacgtgatatatggtattttagtatttatttcccacattacaaataatccaaacagtgactaataggttcataataaaaactctggacgacaagaacaacagttgtcgggcatcagcaattttatacattgaaatttcttcatttgctcctcactgttaggttgaatggttcttcattgaaatgtgtacttgaaaatccaaaatgcatggaactagtttgaagcatgagaatttagacaacaaatgaaaaaacaagaaaatacaaaggaaacataaaaagtaactacaaagaataactaagtttaattggtacgcacatcaattgattaatattaaggaatgcgtctagcactttgtgtttctgctcatccgacgagctggagaatctgtaggtttaggatggatttgtttaactaaaaaaaaaactaaaaaaataagtacttatgatataagtgcttttttaagaagcatatagaatttatttcttaaaataaacaaaaacctatttttctaagcaaaaacaatttagataaacatactaaaaaacataaaacaaattattttaataaataaatttaaataaactcactcttaggtattattcctccaatgaatcatccttaatattattttcaaaataattattataaaaaagaataaacttacaatacattaagatttgtgatga

SEQ ID NO: 6118 - DNA, 1446 bp, Glycine max
  Soy_ogl_2765 Gm08:19201355..19202800 Cluster 27
gtcaaactaatttatggtacttttttacattcaatacctaagtttgaattttatatcctttaagatcaaattatctaatacaaattgaactatttactctaataataataatagtaatacttaccgtggcaatgggttgtttttaccaaattgccattcatttatactagtataacaattttacaatattgtagcaatgccaaacgggtgggaaaaaaaacgaaaataaaaggaaatttgatatgcgagcgaaaaagcaagtgtaatcatcatttttttatatgtaacaaaccaactatgaggtgcgtgcatgcggcgatattgttcgttaacctcacacactcaatgactcacactcactctgtattgcggcacgtgagcagagatgcgcgtgtgttacaatttgtgcaatgaaatcggtaaaagagagagagagagagagtaacgaaaccacacgaacattgctgcacagtgcacagcaacaacatcattattaaatcaaataaataattaatagttaatttcaccacacaaatttttttttataaaaaaaacaaggcattgacgatcacattgacacataatatgctaatgatatgattcttttaccacacatgtatcatctcttcattaacatgatatgataatatgtggggaatttctgatgattttttttaattaagtgataacataataaacttctattatataaataatatttacgcattaaaacattaaatatatagtgcaagcagttgggttctttcttcgggtaatttacaagagagtattagtgtttattgtttgattatgttttgggagttttattattggtttgttttcgtaaattcaactttaaaattaatttcgtaaaaatttatatatgtgtgtgtgtctgtaaaacaagttttgaatttggatgacaatatatataacatatataagacgcattttctttgccatctgacctatccgaatttttctgcctctaccctacattttatcagattatatcaaaataattataaaaactattatatttccctagaaaaactattatatattccttaaataaaagtactatatatatcataataattatagtgtataactaacttaattgtagatattctattagacttctagatggatagaattaccacttatataaatgtcacttgccatatatgttcatttgttttaccagccaataaaatgattacaagagtatcatattaaagttaattagtatttacactaaaaacttgtctaaatactaccaattaaccaataacaagcaaaaaaatcaaaatcccaagtgtagaaacccaactgatgtaacaaaattgctccctcataaatgaccaacaataccccactaacaacaattatcagtgttcatgtccccaaatcgcaactcatgacgtcacttgtgattttcatgtc

SEQ ID NO: 6119 - DNA, 1500 bp, Glycine max
  Soy_ogl_118 Gm01:37222601..37224100 Cluster 27
ttttttgtcaattatattcttatttttttccataatatttaattaatttacatatatgcatttattgtggggtagaaatgaaaaaagataaaataataaactctacaactattttattagaataagaaattttattaaatttcttaatatttatataggaactttaaaagacatgtaaaaagaaatggatgaaatagttgacaataataaaaaagtgtattgttatggatgacatgtagtgtgatgaatattcaattaatgaacatttaatgagtcaatttagaaaattgaataataaacatcataagaaatcaaaaaagtgaattaagattcaataaaatttaataaatattacaaatacttttagaaattaggaataatataaatacttcaactaaattacacaaatctcctttaaggttagataaaattacataagtcacgccttcatttttgcttattacttttatcctcttctgtcaaaattattaagtggtaaaaattaataaaattaaaaaaaaattaaaaagatatgttatttcccatcatgcccttctcaattaacatccttactttttctttacctttgaaggacaaggtgtggaaaatgctattgagtgttgttgtagtgtggaagagcaaggggatgaggaaggacgacacagatagaccgttgtagtcgcaaagtccatgcaggtcgctagtgttgggagcgatgcagtcggatacgtcaggtgttcgcgaagaaggcaaaggagcatggcgtgggagggaaggcaaaggagcgcagcgtgggagggaaggagaggggtgatgggaaggggatgcctgtgtttgtcatgttgtcattgaacaacataatgacggggaacacgatgaattagaggaggttcatagtgaaggggatccacctgcatcagaagcgaagggggtttgaatccaaattcatcatgttctttcactagttttcatttttgcttttgaacaataatagggattctagaaaaaaaaatgaaaatttatctaataccccatccaactatattctacctttcttattcccgcttattcccgtgtttgttattctctatagaaagtttgttttgtttattttctggatttatgttttgaattatttctaattaccgggttctatttaaattaacgtacgcattttactttttaatgttaggttgtgtttgctgaactacagagggattcactcaatgattttctctacctaaatcaaaatgatgttgaaataatgaactttgattggtttcagagcgtattcataaaggatttgaactataagaattgagctgttatttactgttcaatttcaaatcaagttgcattaggttacttggttttcaaagggagaaacttgagaattggaatctaggtcctggacttaagaaatgaagcaaccagattgtttggccttggttcaagcgtgaaaagaattggtaccatgatcttaaaaaaaaattgaaggag

SEQ ID NO: 6120 - DNA, 1700 bp, Glycine max
  Soy_ogl_1312 Gm04:38737301..38739000 Cluster 27
ggagtgcaggaaggaaagaaggagttcatgaagtaaaaaccttaagggacttgggccaatcaagaacaaggcaaaccgaggccggtttcttggcaattgttatttttacctcctatttctattaatatgcctcccttttgtgtgttctgagtaattctttttccaaatataccctccttccggaaataagttttcagagatgaattttccaaaacaaaatgaactaagcaccaatttatcttctctatccctctgggttaaccggcactacaactgtgatttttttcttcttctgaatttcacctttttctgattgtgtagaaagccgattagagtccatcaagaagctagttagagaaaaaaaaaaaaaaacaatttatcttactctcattgtgttccatcccaaacaaacgggcttttttttgttttttttttttattgaacctcttatttgtcatgaatatgtttataaaaactgtcccgtctcatttttcatttattactgtcaacatattacagcttctacaatttttctctttttacattttttttactgaaatgattatatatatattaataataaaagaaatatctcttatttggtgtcctcgttctattagacaactttactcttataacatttcataaacttttaaatttttcttctaaccaatactaacttcccactacttctatattattagttttttttattctgtcactttttttattattatttgtatttaatttgtttttatttattatttaaaaaatttagagaatgtctctcttcccctaataataatggaaaagatgggtaccattcaattgttttgtactttttcaaccgtgcaattgcacgggcgctgatctaacttctaatcatttgtctttcctctttgtttgattgattgtttttctatttagaatttacttttctagatataatcctttggtaattataattacttaattagcctttggacttccgttttacatattgcgtgaaaaattatggtccctggttgccatgatccaatcatgtgtttattttactttaagaaaatttcttcttattctctggatgaaatttatttggtagtacttattgaaattgctgttgcctattttagttctatatgcagttatctgttcaatactacagtactactaaatgaaagatttggtacttgttatttgtactttaaaaaggccgaaaagtatatgaaatattacaactaactagcctgtcttctgcattttgaagtgtcgaattataggcaatttattaaatacatttacataagtggtgaattcttttcctgtctccgtggttggcgttgtcgccggttttcaaaattgatgaattaatctaggggaccatggataatgcatatgaagacattcatacgtaccatatctgagattaactgtggggaacatgttgaaggcaagcatcccaaggctgatctgtacacttgttttctgcatcttaaaaagtgactattagatttcaaaacaaaaacttgtggatgtagaattgttgaacatccatttaaagagggtcatgaataattcttttaccggttagtcataaaaaatatatgttttactaatcaatcatcttagaaaaattaaaatccatttagattgagccgcattaatcgaccatcatctgactaattagtcaattgaattag

SEQ ID NO: 6121 - DNA, 1434 bp, Glycine max
  Soy_ogl_2761 Gm08:19121630..19123063 Cluster 27
tcagaatcatcggttcctgactgcactgattcattaatttcggaacttaaaaaaccaggcgatgatgaacaacatgaataaaaaacatcatacatgcttatgttatcttctttcatttttttagcataagcttcgtagttgaatccaactgtattttccccaccaaaataggattccagcttgtccatgtcaaggtgttcctccatccatgtgactccttgggttgtaaacaaatatcacctttttgtatgtctcgggctctagaaatggtttcaccatctggtaccatgaaaagcatgcttataaaacacaccaagcaaatataacaacactgaatttaagtgatgtccatgaacaaatttcaacagaaaaggaaagccaaaaaaaagaagaaagaaattgacctgtctttctacttataaatcacaactcactttaaactagtatcttcaaactgagcgatacgttataccctcgtacaaattcccatcaagcacacatcgtcttctcgtccatgaaacaagttttgtgtagaatttttaatttgagaaaatgtgcttttagtttctatattttctgccaaatgtaaccaaggtccttatactttcctattggtgaatttgattctcaaactttaaaaacgagtgaatttagtctcttctaaaaacatgtggatttagtccctccaaacttttaaaaacaagatgaatttatagagataacaggttaaatatatgtgtttttaaaatttgagaaccatataggaacttttatcccctttaaccgaaagaataaggactaaaaatatatttttagccaaataataactttgcaaaatagccaagcaattgagacaaactttttccctgtccagttgataatatcagacaactttagttagtcaatatcattacatacaaactttttccctgtccagttgataatatcattacaactttagttgataaatttggtaaattgtttattgaaaaaatataaaaatcaaggatcatacacgtagctgacactataagacagggtcggtttaacgcattatttaaatcatttcaactctatttcagcaacttcttttttccttcatcatcatctcttcctctcgccagaaaccccagcttgctgctaagggttgaaacttcaagcatgcaaatgtgatgcaacggaaagacgagcaatcgctgaaacgtgaaagtgttggttactcaaagaacttgcgtgatttatcggtcacccaagactcccgttaagttaaatgtagctcaaatggtttttaaattatttttaaaacatttttatacttattttcacaatttgaaaaaggttttgtgaatttaatttttaatttttttaaaaatacatttttcacatttaacaataacaatatttgttataatcattattattattatcatgact

SEQ ID NO: 6122 - DNA, 1000 bp, Glycine max
  Soy_ogl_4012 Gm12:7695101..7696100 Cluster 27
ggatgggaaatttagtttgtgagtggttgtatttgatgccattatctgtttttcgtggctgccttgactatttgtgggtgcaaggggcatctaaatctggcatgggttgtatttgacaaacgtgtataggtgaaggagttgaggtcgtgctgcaatcttgcctctgttgtcatcataatatacctttaaggatgtgcttaattcttctattggtttggttgtatatttggggtcttcattgttgggtcggataatggcaaaggtgtagcgtgtggctgaagggaatatcttgactatggtctagtgtgcttagttggagggacatgcctatctttgtatgtttatgggcctatatcatgtgtcttgttgttggttcctttgatcggtcatggttggggactggttatggttctaatttgtattttattttctataaattttcccttttctttgttgtactcttggctctggttggtcatatcttatgcagcttccaattctttggtttgatatattgtgcactgctataaaaaacactactttcaagtactaattgtaacattacttcaacctctcagttataaaaaaaaaattacaatttttggataagaaaaaaaaaatactcagacaaagaatttgtcatcattcacctatagtggtcaaagaaaaaatttgtcatctatatagtgatcgaccaagattacttttaatagaaatatttgcgatctcatgcataaaaaaaatagttaaatgaaaaaaaaaacacgtcattgatttggtcctttaaaaactattactttagtatctcaataacaaaaattataataagtcattcgattatatagaatcaaattttatttagtcttttcaatcataaaaaaaagtgttaatttaggctcaaacctcgtggtacttacacataagaacatttttcatgtcattcttctagattgatatacttcagggcgtgtttgattagattaatacttaggaaaaatat

SEQ ID NO: 6123 - DNA, 1300 bp, Glycine max
  Soy_ogl_4766 Gm14:43220001..43221300 Cluster 27
aataaaaaagaaaacttaaccccaactcctacactaattacatttaatttaatttacttcagcaccctttgtgcttttgatataaaaaaaaaattcaaaaacaaatcttcgatactttctataattttaattattgttttccttcaacaagaacaagatcgaattctaactatatatacgtataaaaaaaactgtttcattataaaagactcttgatgatttctctgcctaaaaaactggttaaagaatatccccccacacaattaaaaaaattaaatgaaataatatctgaacgccattcttgatgcagtccatttctgatgaaaagttacaagttttaggtatggaaaggtgaggcgccaacccattgaagcattttctttggcattgtatagtcaccaaagcgaactgcttgctcgttatggcaacatctgtcccattaggagaattggctggattcacggtagccgaaaggcaacataatatccatcttttaatttatctaataatcactttctcgtttttaccacctttctttttaacgtactttgcattgaagggctatatgccagcaatagccaatcacccttttatcaaactcaaaacaactagtatttgctccctcaaaccgcagcaactattcataattgtacataatccaaataatattcaatgctagcccgtaacaacaactcaccatctattgacacggtgcaaagttgattaaaattataaagtataaaatttataaatgtaatagtatttttttttgattcagataaatgtaattatatattctcaccatggtttttttttataaaagttatttattgattcgttcattattgatctaaagagaatgttgacaaatttactacttatacataacaactatattcctgtttaataagtggattctaaaccgtgctttgtatatgaagctgtatagatattcattaagacaaattttgttcttcatgataattctgtttgatttaagtaagattatttttggtgaacaatacaacattagatcataggtattttttttttattgaaaataaatcatacttgagctggatattggatatgactattatagataaaaaaatttcttccaaatatttaatataactacataatagttaagctaaaacaatttcatcgatcagctctaagtatatatgtcatgaacgcatgtttatatatcatgaaggcataagtatgctcactcttcatgtggggaccgttggatcgatgtccttcttcatagagcagacaggtctacggagatccatta

SEQ ID NO: 6124 - DNA, 1450 bp, Glycine max
  Soy_ogl_5685 Gm17:14369601..14371050 Cluster 27
gattctatcaaagctaaaccattgctgaatccgcatgataatgacacgttgttttggaaattcactcccaatggcacttacaatgtttgttctgcatatcattgtcttatggataccatcctagaaaatgatcatttaaaagttaatgggagctggatgaaaatttggaagctaggggttccaccgaaagtgagacattttctttggagagcacttagaggatgcttacctacaaggcaaaggcttattttgaaaggagttcaatgtccctacgattgttgccactgttcgaaccacttggagaatgaatggcatatttttgttgcgtgtgacaaagcccaagaattctggcaatgtgcaaatttgttcaacaaaactcatccattaatgctttcctcagaaggtttttgtgaactgatcttcaacctcttggagactcaaacagaagcacataacatggagcctagaccagatgtggcatccaaactagctaatggaaatcaatgagaacttaatagcaacctcctagtctcctcccccacacaactatgccaagtgtaatctcgacgcagtgatattcacgggacaaacctcctttggagtaggtatgtgccttcgtgatgacaatggctctttcatgacatccctaggcttgcagtagctgaagcagtggccctctaaaagagcattgagtggattcaatcactgcaccttagccatgtgatcttcgaaattgattctaattaagatgataaaggaccacttgggctcgggtagaataggattttcagattttaatagattcttacaagtcgtcaacacaacctttctattgtaccaaactgagaggtaagtttaattagttaagaggcaaacaaagcttgtgacttatagacttacaagggcaaacaaagcttgtgacttatagacttacaacctttctctcatgatgattaccattgtattcctcaacatgttttctctactattattgatgaaatgaaataatcatattttccctaaaaaaatcataaagaaaatatatccattaaaaaaatcataaagaaattgaaatacataactactttaaaataatttttaaatatataactttaaaaattacattaacacatgattgttaatttttaaataattactttaaaaatatataagataactttaaaataatttttagactaaaatacactttatcccctattttaaaagcaagacatttagttgacaattttcatcttttatgtgaattgaggcgtgaaaaataaggagtccatgtgggaattgaaacaaagacctcttaaaaaaacatagtcatcaaaccaccaagctacatgttctcaatactcaatgttgtaaataatagtttttatatatcatttgtataaatttcctaaaataatttttttacatattaatttatgtaattctattg

SEQ ID NO: 6125 - DNA, 1500 bp, Glycine max
  Soy_ogl_5690 Gm17:15298201..15299700 Cluster 27
acaaaagaggtaggggcaaaattgtcaaaagcaattgaacaagacccatcatttggatcgtgtagcctaagggacataggaggccatgtttagaagggatagttggctgaaacatgtaaaccatgatctcctagatttatgatagtggttcggagccaaatttgatatctaagtgttttttgttcctataaataggacttatcaggatgtaaaacggatctcccacttttggcatggaaatcaaattttccttttcttgcatagttttacaattttctttactgttcttattgcctttaaatcacatttctttacttaattaccaacactttactttagtcgtttattatattcctttactgtaatttttattggagtagtttagcctagaaaccttaaaaacatcattattggataactctttagaacaaaccactcaattaaaaaacataatttctttcttgacacgatcactgtaagaaaattgactaatgttagttaatattatgactaatcagatttcacaccaacacatgtataataaatttattaatttttataataattataagttatatccacaataatttttaattaattcaactgagtagtgtaaattttttatactgcatatgtacgtttgcatactcattttatttctgatagctatcaatcaagcagtttggataaagtttcagtatatatgagtacccaatatcagttgggataatacattcacatactcttatctaaatataagcgcatatccatacgtgtctggtctgggatgataaattttgatttgtctctgtcttcccaagttcagtagaaaaattaaaatttgcaaccgcgtatataaagacatacttgtgatctgatctcccacgtcccgttgctttcttttttcccctctctgaatactcttcatgaataattccgtatattgcaatagtatcagagggggcaaaatttatcaatattttataatattgaatataaagtcttgatcatatatttcattacaacaaattgattaaagaaatgctatcattaacaacttttgaaaaggacgaaattcaggtcactttcaaaaagataattttaattattattgctctagatcttgtcgaatttctgaaaagaaaaattatgtgaagaatcaaatggtcaagtttgcatatgataataacgatttgcttagttcttaaagatggggagacctttgtcgtgaggacataatgatttaaaaaacagacatcgtgaaacatgaatagcactccgtgacttttttcattgtcttatttcacggaagctgtcttctatgttggggttgtacttatctttatgttttttcatatcttctctcttaccaaatttcgaagaccactatttacagtcttacactgttgaccaaaattacatatatgacttagatgcacgggatgagccatacacaaaaagagctcgtgagtggaaggatggtattttataattttgaaa

SEQ ID NO: 6126 - DNA, 1200 bp, Glycine max
  Soy_ogl_452 Gm02:9148201..9149400 Cluster 27
aagagggttatgttatgatttttatggccttcattcggtgcaacatttcaatccagaactaatctaaacttcaattagttaattccagtactatctatttagatcttaagctatgggaacgtggtattgtcaaaactaaatattcttttccatttacgcttttcattcaataatttttggcacactacatatagctagctaataacattaagtgtgtatcttaccagaacatatatatacacattcccctaaatctcaatgaatccaatgatcatatatatcaaatgtacatttgatgtatgttaaactgctctatttggcattccatttttcaacaaactttattttctctcaaatcttagcaacccatcatgaactagacacatgtagttggattcaaccatatatttgtgcaaacggtaatatatgcacgatcagtgtaacgacacactacattaattatattgattttttatacatattttctgatgtcatgactacgtctatgtcgatctttctgtctctaaactttggtactacatatttgtaatggcatatgctattctgaactagctgcatacggtaataattatgcttgtactgttagtcctgcaaagatgtgaaattggcaaataaggccagaaaaacttttcattgtacaaatcgattttgtttttcttacctatatgtgtgtgacaggtttttcattcattcggctctctatttgctttaattggggaaatgattactgcgaagcgccaagaaaaattgaatgaagtttggcttcgcatccgcatacggaaaagttttaggtacaaatttagaattaaaatgtacattttgttcccttttctttgtagctatttcttgaatttttttagtagtcaaatcaattatgtttcaatcatatgcttggtaaattattaagatccacttaatggtgagaattttgagtactttttgagttcttaagtttaggctttattattgtaatattatgtaaatctgcgtgtaagtaaaaatcattctactcatgtgtgtttggggtgaaaatttgcataattgattttgaagtgaatttatctatgtttgaatatttttattgagttaataataaaatttaatgtaattttttttaaataagaaaaagtaaaaatagtttagataaacacattttattgcaataatatataattgacg

SEQ ID NO: 6127 - DNA, 1200 bp, Glycine max
  Soy_ogl_3415 Gm10:9996301..9997500 Cluster 27
ctttgtcagaatatacgtatgtggtggtcgctaccacaacaccggatttgcaatggccccaacctcgtgtggattcacgcatctatatatcctcaaggacaccagtggtacctccactggccttcgcagtactcattcaacattcctcaacaactaatgcatgtcattttataattcaacagttttaacagcttaaattttccttttatgtggaattagacatatcaaaagtatgtccgccaccacaaggtactaagcaaaaatatcaccttattcttaagattttttatatatacaaaaaatccattaggattttccaacaactatttttctcacacttttgacattactaaaaatgtcgaacaagatacgtcaatatgttttgtccaaaacaattattaattgttaccttattcatcaaggctattaaatcttaaaattattatattatttacattacttaagaatttaaaattttaaatacttaaatctagtaatgaatttattaaataaatattgaaatttccaaaaacgaacttagtaatgataattaaattaattacttcaccattttaaacctatagtaggctgttctagaatatttcaaataaaaaatccacatctttgtcaataataatttcttttccatttttttctaggacttatcgcatcactttctctagattttattagaatcattcttatttacaaagttcatttatttcctatgtagtcaccggacaagagcaatcagaaaataaatcttttgaaacattacacaatatgaataattatttttaacatgattcatattttccccatcttcaaactttaatttttatctaatagcaattattattatttttatctagaaaattaaaaatttagtttctttgaaaattattatatatacctaaaagcttaaattctttcttctctaaaaaaacttaaattctctcattctttatctaactaaatgacgacgttaagtaattattacttctaactttcgtatctgttttcagtccatacagcaggacttaaaacagtccctatatggctcacggtcctactctcatgcagtgatataaaaaattccaacgattcacggttgaaaacttaaatattataggtattttataactttgcaaggataaccattatattccagtttaggcttttaggtatataaaatagtat

SEQ ID NO: 6128 - DNA, 1280 bp, Glycine max
  Soy_ogl_3429 Gm10:159729..36771008 Cluster 27
ctaggcataaataggcagtctcttcccacctctcttgactttataagaaacgtatgattcacaacaaatatacaacgccgctacatttccttctttctttcttttttttctcaattctcatttcttacacacacatgacacagcactgcttcactcactactctatatcttctctcaatcccacttcaaccaaaccacgcacacttatttttccccccaaaaaaacactaataataaatatgatatagttgcttatgatcatgatgctttcttgtatatactataatgatcataagcaactatatcacaccatgcatatggctacgtatgacaccatggcctttcagtttcactcttccttgcatgttgaagacgttaaaaacgaacatatatgatcctgcatctctagtcctggtacgtttaatcttctaaaattacactacactcttacaagttacaacaaaactaacatatatgatcctttccgtaaagtctagtcttccaagaatatgtgcaataatacatctagtcaatcgtttacactgtgaaacattaaatttagtctgcttgcaactatagccataattaatttacagtctttttgtgtggtgatttaatttatgatatatctgaattctctataagaacgacctctctaatcgagttctttttattttatatttttgtcctaactttgtaattaaggtgacgatccaagagatgaaaaggctcggctcaagatgtgggcacaggcgatagcagcatctgcatccaaatatggttcttgatatggtaattttctcctaactaaacccaacccctttttctgtggaggctgtataagatctaactatggctatgttggattggtgaagatgatggaattgagaagaatatgatatcaaaaaggattcatgaacatttcttatctatttgacacctctgataaagataaaaatatataaatataataaatgacatcgtaaaataggatgaaaatgtaaaagaatattataaatattaatgaagtatttgtaatagaaaatatatcattattagtaaatgtattacgtttcattatttatttatattagtgaaacaataatgcaatacttaattgtggaacactggaaccctattttattttattctatttattaccttcattttttttgcccctctaatttgtaaggaatgagattcaataagaagcttttcttaaaaaaaatgcaattaagaattttaatttgttctatagtgtatctaaacaaggaaacaaa

SEQ ID NO: 6129 - DNA, 1312 bp, Glycine max
  Soy_ogl_4193 Gm13:21870189..21871500 Cluster 27
aaaacccatacattcattttatggtagaagtttatgattgcccttgtcccataaattactagtggttaaaggcaagcataacgttagggtcgttggacccgcccagttatctcgttttgtaaattttaacgaataggtttacctaacattattgtgtttttctaatagtacctaaacactgatgattttgtatacatatgagtagacactgtttcctggattcagtgcatagtctacaatctacatcacaagttttgtttctccccactctatagtaacatgtaatcgggagacacctatacatagaagacacctgtacacagaaattacaattaaattcaaagtcgtttacagtcaatcattgttgttgagtcttgagtgtttttccaatttctaactttcttcttcttcacttaatatgaaagttaattctacacgaaaaattataacgtttatattgcttctcgttacaggggagagagtatatagtagaatcatggaacctcaaggacaactaattcttggaaaatgttatgcgaaaatcaaatgggacaacaaagttgtcctacttaaataatttatatgtaacttttttttaaaaaaatgtcaataaaatatttgtgactcggaattaatgaagaaaaaacaatttatgtccctaaatttgattacttattttctctatttttgctgtgaattttggagtgtattttttgtaggtgtgtccatggaagagataaaaaacaaataatagataaaatatttatgtgatattatatacaatgctaaatttttatgtttagatagtaaagctattttttttcttggcaaatacgattggcttgaaaaggagagaaacataatcattttgcattgatttactcttgtccgggcatatttttcaaagcattgttttcactattttgtacgtacatacagccatttaattgaataataaatacatttagttgaataagttttttggagtagggtgttgacactactactgtgattttccagtaggaaaataaacaaaagaaaaagtaatgaagcaaaagggaaatattactgggcctatgttggcccagagtggtaaaaagaaagaaaataagtacacagttactatttatacttactctctttactagtacactcccttctttttttttctaaattacccttgtatacacactcctcccatatcttttctacctcatgttctttagaaaaacacacatttctcttattttcaaatttatcaattgcatcataatcacaattgcaattgtaattaataaccattctcccaaaa

SEQ ID NO: 6130 - DNA, 1539 bp, Glycine max
  Soy_ogl_4254 Gm13:24839962..24841500 Cluster 27
gaagactgtagttacgtgtgtctttatgctcattgtttggcagcattcaattgatataaagtttgggaggattctgtatatagatgatgcctaactgtacaactcaattctcaaaatcatttcaagcatatgcagagtactaacaacgtgccataacagattgtcataactgaaggttaacaatgttttgctcatgccgggtgggacttgaatccacaatcgcctgattagatcatcatggatccaaggctaaagcgttggaatgacttattggtttttcattgtagtcggattatcattcacagcatttgatctgagtctctaggctttgaaactcatttttcaagaaagtagcttgcctattgatattatgaggtcccacatcggaaagtgatctcttatttcaatggtttatattctgattttgaaagccgacgtttaaatttggggtgcaggatggatggatgccacttatgattttgactaaaccctaaaccgacttaatattaggggtatttctccaatgtttcccccgtgcggtgaaaaaagaaacattgtagactttgcatatgttgacatccacggtatccatggagtggtttgcaggtgaggttgcctacatcattatccacatgatgactagcgattcactttctcctcgcctctcaacctactccccaccttttttttttttttctaataaaagaataacataactcaatttcaatttcatttaactttggtttaaatataaatttaacagacatttattatatttaataactaaaaaataattctacttctactacctatttaccgcacagacctatataggtttcacagaatatgttgtaagtaggtatgttcaagaccgaaacaaaatgtttgtaaactgtcaaaataattttaaagaattaaacatcacttaaaccgaaaatctaaaataaaaaatccaaaaaaaaatcttaatttttttgtttggttcgatttttggattcactgttataattatattgaatttatttaatcaatgtttagcattatataactaatattatttataattattatagtatcttatttatagtgtactactttctacattaagtttgtaatatatgatttttgttataataattaataatgtattgaataatttattaaaaaggatttatcattattttataattaagataaatattttattttcatatttattttagtataatgaacaaggtaagccaaatacaacacatcttgatgaataaatttttccaatcattagatggaaatggaattaggggtgcccatatccaagaaagtacactagcctcttccgaagatcaataacatggctgtacttatttactttacacaggatataaatataatacttatgatatgatgagagtactttaaattaaattgtgtactataattaaattataattaatattatttataaaatattcacttcagtagtatattaattgcattagacgtgagtcttcccgagaatgaagttggaaattggtctca

SEQ ID NO: 6131 - DNA, 1200 bp, Glycine max
  Soy_ogl_2014 Gm06:19087201..19088400 Cluster 27
atactagttgtaaaaccacagtaccctagagaaggcagatattcaattactaagatagtgtcgaaggatatcgtcgaagcctaaacgaccaagactgcctttggaactcccatcagtgttgaccttaataaaaaaaaaaaagaccttgtggcggctcccaattgacttgacaagaaggttgaatctaacaggcatgttgaaaggccaccatcatatcgttatagatagtttgaacctgattaataagacgccaaatgtctagattcttatcgtaaaaaactgaagcattctttgccttccaaagagtccaacatgtcaccacatacaaggaactactagagctttccaaattagacaacaccattcataccaatccacaatatagaaatttggttgttgatcaagcttcaaatgacaacaaacttgttgagatagtccacaatcctaaagtaagtggatcatcgtctcatgtccattgttgcacctgatacaagagaggtcaaaagaaacatgtttatagacacgaaaatcaatagtggggaggctcccgtgtaaggtaaaccaaaaaaagtgtatgatattttctgaaagttttagtgaccacactcaagactagttcttaaattgagtattagacgatagtttttggacacagacccataatggaaatattatatgagaagtataatgaatttttaggtattttgtttgagagaaataaagaaaaaaagacataaagagaaataaaataaaaataagttttttttatagattattgattttagtttttgataatcaatatttattcttgtggttttaaattgttggaaaattaagaaaattgccacaagaatttcaattcctcagatttttttagctgccacaaataagtttgtttttggcatttttaaattcacaaaaaaacacataaaattgtcataaaacgtcaatttctagctggcccaaataaatcaccataaaattatctcatttccacctagtactattcattttcacacaattttgtagggaaaaaaagtataagtatcataccattttatttctctcttaccttagttcctcccaactaaacaacccaagcttttcacatctcacctatttctcctccctccttcctattttcccataatttccactttacgaaacagtgtcaataacacatggtggcacttggtagtt

SEQ ID NO: 6132 - DNA, 2272 bp, Glycine max
  Soy_ogl_2366 Gm07:19191501..19193772 Cluster 27
tcatgatataagctaccctaaaggcctaaacaattttaaagttagctcttttaaaaaataactgacaaaattaataaactttaaatggataagatgttgtgaaatattaattccaattgacatcttaaggcgcttaagcctaaaaaatcacataatttcttgtgtcattttgcatttacccataattatacctctcaattctcagtcaagacatgaaatattcatcatttgattgtcccattttaccttctctagcattgagcgtgtagggatccaccacccattatctaaatcaagcatctcaatatctgaggcaaatactgcaacgacagtgtcaccacctcaatggaatcctaacatcgcaccacgctctattgcctcggtgcccatggccacgtgagctggctatgcactaggcgctaaccctttgactatctgaggcaaatactgcaatgacagtgtcaccacttgcaccacttgtttgtagctgcgagacatggtggaaagctttgataccaattgatagaattgagaaaactacaccacaaaagctagttgatccgaatgccatataaagcctacactagaatcatatacttccaatgtgggactcaagtcccacaacttgcaatcggatcataatataaccccccaaaaattgaatctcactatatttaaattgttggattcgacttgttttattggtttcattctcccactacaatgctgcagtagaagtgcagaaccaaaaccttttcaattaaaaagggaatttcaaatctgtgaagagattgtaacgagtaaaaacaagcattggttctgtactacaatgctgcagctactgtttgaagtccccaaacaggtttatagatttttgttaagtaattatcctcatatgtaatttttaacttcagctactgtttgtaacgagtaaaaggaaattctcacatgcttggtcaatttctatgataatcttatacattttaatgcattccagcaatatgcttacagatgtttgggatggagaaacaattgaaaaacatgataaatttcagatagaatctacaacatagaaaagtgtagcagcttctgctccaggtagcaattcctctctgtctgtattttcttgaaatttgtcaattctatgacctcttgcaccaactaaaaatacactaaaatttagttgctcacaaaataaattaacatatcgcatttaatgctttccatcaaacatcctaaaccacctgagctatgttatgttgatactcaaatgggggattagaactctcttccatcctatctaaaccatccaatgcctccataacccttttctgtgttattaaatccaggagtatcattggcattgtttcccaaagataaatcttgactttaactgtcgagtgttaattccttcagtttcataaatacgctgttctgctcatccttgtttacttccttttcaacttcattagaatctgatgaccagatgtatccgtctaaagaaaaatcattttcaatccaatctgatcttgtaattaagtgagtagaatgcactgtctctaaatcaagcattttagatgttttacctatcctcaaagattcatttgatgcaagaggtcatgatacagtaatccacctctgtgtattctgcgaggcagaattacaagaggcaattgctccagctgatagtaaggaaataagtttgcctgtttgtgcatggtctagctcaaaccaaaaatgattatgagtgtagtagttgtctgcaattacttctttgaatttatcttcaggaagtgggtggcactgaagtcgaacacaaatttgcaccttaaatattttaaaaaaaagtatgcaagaaggccttttcatgaatcatgatgacaattgtcttgaatagaaccatatcaattatagtctacgagttggtgatttacctgtgcgggatactgtgttctctctgaaccatctgtagtcgatagggatctatatacattctaccactgctagctgcctcaaaaattcaatgaagtttcctatcagtataattgaactgaaccagaggcaaccctagatcaatattcttcatataagagaagtgcgtagctggtaaacctgttcaaaacagataaaagttcccatgagctagagattacaatcctcatcttcactcacagtactgattatcatatgtaaataatacaaaatttaagcactgagttcctgagaagatagaagtgttcccaagttacagagtagagacttctgatgagca

SEQ ID NO: 6133 - DNA, 1400 bp, Glycine max
  Soy_ogl_2372 Gm07:20315201..20316600 Cluster 27
atataaatttaatattcgtgtaagaaaaaaaaacacaaaactagttattctttatgatccgattatctattgcaggcaagagataaaaatcataaaactctatggagaatggaaagtttcctttcaataaagccatgattgaagaaagagaagagtttgcatcattctagcatatggcactcaatcaaaacataccattgccttcgttggaacaacaacaaaagctagagtccagctaacgtaggctctcaaaagggtgaaaatgatcagaacttcaataagaatgtgtttgattttgagaagagaaatatgataaataaaaataaaagaaagagtccagctaacgtaggctctcaaaagggtgaaaatgatctgaacttcaatatgaatgtgtttgattttgagaagagaaatatgataaataaaaataaaagaaagataattcgaaaaagtaaaaataaaaagatatgttgtgttgtttgatttaagagaaataggtaagagataatatttttgtattaaagaaaatcaatttttttgtctaaaaaactaattttcccctgaaaatcaattttactataacggaaaagatgaaaattctaagttatgggttcaccacttataactttattttcctcaatatcatcgcaattaaactcacccatcgcaattaaaatcaattttactacaacggaaaagatggaaattctaagttatgggttcacctttattttcctcaatatcatcgcaattaaactcgcccatcgcaattaaaatcaattttactataacggaaaagataaaaattctaagttatgggtttattttcctcaatatcatcgcaattaaactcacccatcctgctttcgtcagctgtaacttattttcatctgtagaatcaaacacggcctatgagtaatcatatagatttagccaataccagaattcttaatagtccaacacataatccagatttggtttactacgtagtggtgcaagtaagcatcatgaatgttaaaatataaaactttcaaaatgtgagggttgtcgtattcaatcctaatggtactacactactacgtgcacatgcgctacccatacaactcattgtactctgtttttggctgtcatgtaagtggaaccatgtgatcaacagagggaaagaaaacgtatatatctaccttgtgaggttattttttttatcagtccttgtcaggttatttaatcacatattgataaataataataataataattttaatctttgaaatttggaataattctatttttggtttccaaaattataaataaaaaattattttagtctcctaaatttttaaaaaatatacatgtttttagtcctggagtcgaacagtatttgatgtgatgctaccaacttt

SEQ ID NO: 6134 - DNA, 1340 bp, Glycine max
  Soy_ogl_2781 Gm08:21868342..28681 Cluster 27
tttatattgcttatatgttgttattagacttatacatgattatatctaaatttatattgcttatattgtttggaaatgcttcacggtattggtattttgttacttttgaaaagataattttacttgtattgctttgttgtttatattggaattggtatgttgcttatattgcttagattgttcctgtattttgcttatattggtattggtattttgcttatacacagtagtggtattttgttgcttatattggtattggtattggtattttgcttatattggtattggtatcgggattttgcttatattgcttattttgcctaggattgagtttatccctaatttgtaattggaatgtgtaatgcatgtaagcattaaaatttcctaattcaaactaattcaagcttatatgagtatgtgtagggttatctctggacctaattcaaactaatcaattgtaagcattacagtagtcacgtggctacatttaagcattaaaatttcctcatacaacatgattaatgggtctgtgtctgtcttacccattaccattacccatatatgattggacagagcaccaattggaattacaacatagtcctaggttgaattccttgattaaattccaagcaccaattcttgatgaatcctcaccaaatcaagacagacaccatgaggtgcaaaggccaaactcacccaactaaacccccaactcccccaccccacccagactcgacgatgacagtcaccctagcatcaaccctgctccatccaaccaggttcctacaattatagaaaccaattttggtttagagaacattgtgaaatttatataaaaaattgggtggaaattttgattaatgaccctgaatgtaaaaaaaaatgaaaaagaccttctgctttgtctatcatctgagcatacaagttgacatctccagtattacccaagctctctcagcttccccaaccttgagaatattctcaagaccttataaacagacattgacaattcctggctcaccaaataccttacagccacataagataagtcaatacataaatttccaatatttaccaattcatcatgataagaaggcttgattaaacacaagaattttcatcaaacttaatggggaaaaaagatcaattggcagtaagaaggcttgactaaacacaagaatttacatcaagtaaaaaacaattatctataatatgttcctatataaaaattagacacaaaaaacacacaatatactgaaaagaccccattgaatagcatatcctgacatccaaattaacactactactctgaattgactacatgttcttcattatctaga

SEQ ID NO: 6135 - DNA, 1500 bp, Glycine max
  Soy_ogl_2809 Gm08:35500001..35501500 Cluster 27
gtttataattatttctcacacattattttctctctacattaaatatttataactatttctaattattctcacacgttttttctccattatttaagaataaaatataactttttatacagaatatttatatgcacaaatgatttaatttatttcaaatttataattaaagatataaataaaataataaattattatctatataaagaaatatgacttgactaatctgtcttcttaattatcaactcaggtgtgcatgaagatcgcaaaagattcacagccgctggttggatattataaattattgtagaaacgagcgagcgtcaattgtattaaccattttttatgatttcttattaacttaacatcacagcaacgttaaagtggccagaaaacacaaattgacgtataatataatatacatcatattatagcggtgtctaaggtggttgagtgacataggtggtccaccgtggtcaaattattttaacatgtagtagaaggtgttttattttttttaaccagttatcttttaaaaaaaaaatggatgttgacagttataaccttaatgaaaaatagtgttgtgatgtttatgccttattggtttagtttttttcttcttcttttcttctctttttcccaaattttttatgattgttcacagcttcaccttctgtcaacacccactccacaataccatcccaaaaccagaaagcccacaacctccttttcaaacatcctcaatccagacatcaagaacatgtttttgggtcgcaatacttgttcttgttgccgttgtagaggcttttgagtttgacgcgcagggaggattcaacgttcgattggaaatgcgccaagcacggaggaggtcgaaggaggtggcgaggaagtcgaggaggggtgtcgcaggtgatggagtggttgtcggtgttcgcaacgtctccgacaaaaaaccagatccaataaataaataccagatctggttcggttccttccgcggcgttgtcacttgctgcttcgatcgcacggcgtgagctcaacctcggacgtcgcaatgaacttcaattttaagaaaacacatttgcctccgttatctttttccatcgtagcatcgtcttccgtaccagatgggacatgacttttgcttccaaagagaaatgagtaaagtgcagaagggagaaaataagaaaataggaaaataatataatcaattcaaaaaattattaaataaaataaactatactaactgcaagagtcagcaatcagaaccgttcaattttataacattaaatctagcggtacacattaatttgaccatgatggaccacttatgtcacttgaacaccctagacttcgtccgtattataatacaataatctttagccctaagcaatgaaccaaaacaagaaaaagcaatattaatgtattaattgataggaatcgtttccacacgtgattttggacaagtaattagataggacaaggccacgatactgccttgct

SEQ ID NO: 6136 - DNA, 1435 bp, Glycine max
  Soy_ogl_3878 Gm11:18121101..18122535 Cluster 27
taaaatggccaaagttacaaaaattagatgttttacattgtgaagtgctgaggttttttgccactgaatttcaaaattccccagattcacatctagaggatcgaaatagttttccaactgaccagcaagaatctgtctcacttaggaaggtaatcagcagttttttattttgtgcttatgcattcattatttgaatatagtggcttatttcattctttaaaaaatgcttattttatcaaataagtttaagcaaacgggtcctatttgtgtgataagttcaaagttggtgaaatatttttatttaaagaataagtgagtttattagtgacaatagatgctgatatactcactcaattattttctagaaagagtgttgcaaagttaaaatattttaaagaggattttaacaacatacacaaaatacttattcattctctgaaggttgagctaataattaagtgaaaacataaaatggatttgatcaaggattttgttgtgtaaaatttaaaaactcgaagttaaatctcctttttggccaactcatacttctaacttactttgaatactaggttactccccacttgagaacttgtgtctgggaaaggaagaagcgatgatgattacgcaaggaaaacttcagattgatctccaattaggtttggtcaaattgcagagatttgatgaatcagatgtatttccatttgttttcgtttcagagaaattggaggtgttaaaagacggatttgataaaggacatgatttaaattctgtgatcaaagaacaatctgatgatgccagtagtgtaatgacagattcgaacgacttctataattttgcacgcaagaggttatttcttgattttgtccggtcattaataacttgattatttgtagataatagtagatagaaaaatgctaaagaagtcctattgaaaccaagaaatataagtctgtctgccgtccacaccagaataaattaagttttccgaaaaaacctgctagttttgtttgttcagtttgttaatttctctattaattcagtgatcagaagactcagaattgttttttgtttctgtcctcctcatatatgagaaattggaaacgttagtttaataatatatgttctacctgatattgttttgttcttctctgatcacctctcttttattaataatttatttcaggatatggtggagaactagaagcttgttatcattcccttgtctaatgcaaattttccagcagcaacagagcaggaaacctgaatgtgggtttagtcatttgtgtgcatttatttttccatcttgtgcaaagatgcatgaatatgatcgtacatgataacttaggacataactttttgtagaaacttttcactagctactttttattttaactttcaagaatatcattcaaatattatttcacttcttttaaaa

SEQ ID NO: 6137 - DNA, 1300 bp, Glycine max
  Soy_ogl_4044 Gm12:15367801..15369100 Cluster 27
catttcactagatgcaatggaatatttttaactttctttttaaacgtatcaaatggaatatattgttaataataccttttaatcataagtaattatctaataaatgagtttggcgatagtaaaatatattttttttcttcttaaatgcataaatggaaggttacaaatacctctataatcataagtaattatctaataatgattttccttttgatatggttaatgaatcattccagaggaaaataggagaattggagtggagatgacaaatgagtaactaatatgatgtggcaatagataccatttgacatggtagtgtattattcggtagctgatattttatatattataaatagattaaaaaaagtttgataagttatcttaaattattttttcaaggaatcggttaatgacaaaaatgagaatttatattttggaacactgatatgatctatctgtctaatatgttgcatggcctgcataataattttacaagtctcgctcgttaatttttgacatagtatgtcaacaaaacagactactgtacatgagaattaaaaaaagaaaaaacagaataaccaaaattcagaaacaattctaatacaacttatgacacaaaccaacaatcccgaaaaattgagctgcgcactactcctctaaacagtttctcattcaaaccctcaatgtgaaatttacgagaaaaatatgtgaaaatcacatacaaaaagaaactaagcacgaggcgtctcttgtgtaatgaatagcagtgagcacgaggcagagagaaaaaaaattgaaagtgaaagtgaactaagcagggaattaaaaacgcgctgtatattgttttaattttatttttaaaattgtttaaacgctgaatatacaacgtcgtttcagaaaagtgttgtatattttgtaacttttatttttaaaaaattttataaagtaaatatagcgctgtttataaaaaaaaagtatactgtatatatttccacaaaagtacgtacacgcttatttgaaaaaacgttgtcattaggtcccgtgtttttatatatagtgattagcgctatataagagacactatatataaagaattttggcgtattgtggtcacgttttggggtagcgtatggaatggaaggtgatatcccatatattggtggttttgatccccctatgtctgactatgggagccattaagggtagtgacgccctatgaagcatcgacacggacatcggacacgacacggacatggacacgtggacacctataatatccaaaaatataaaacgtagtacg

SEQ ID NO: 6138 - DNA, 1000 bp, Glycine max
  Soy_ogl_4205 Gm13:22288401..22289400 Cluster 27
acaaaccagtcccattgtcgacaagcgaagcaaaatggaggtgcaacaaagtggtggaaaaccctttggcgtaagcaaaatcgggtttttcccacaacgtggatatgttatgcgcgacaaggatggacggtattacaaaggggagtgcaaaaacacttgagtgtgaagttaatttgcaggacattcttggaaaaagaattaccaggagagtgtatcggtaataatggggagtgaaaatagaaaatctctttatgagacacttaactaaagtaattagctaccttttttaaacacttctgtattttttttggtctttcactatgatgtctcttgaaatattattgtgtaactaataatttcgtgtacaatttctagcaaacaatcatatactaatattatcgtgctttaaaaaacatctattttagaaaaaattattaactacattcaaacagaagtatgacatatgatttaattcgttactgaataaaattctatttgaaaaaaaaaaatcttttcttcaatctataatttcttttatttgtaagaattaaagacaaatataaaaacatttactataattaactcacgcatcgtaagaatatatcacaaatacccagaaaaaatttcataactaaaccctcttaatttcttcaatatatacataacagagtgattttgaaaggatgtttttatttcttcctttatttctctacttttagtgtaatagtaagaaaatgaaatacttttacttcttatcatcttatgtactgaaataaatggtaatttttattttgtctttaaaaattaaatacccataccatatataccattactattatgttaagtacaagctaacgctcttttgttaatttccaatgatggaaacaattttgagaggatagaattgagtgctgttggtttggtagagatgataaaggtgataaataagtttaaaaataaggagattcacatatactatttttcatctatttttactcat

SEQ ID NO: 6139 - DNA, 1043 bp, Glycine max
  Soy_ogl_4740 Gm14:13529601..13530643 Cluster 27
aggcatggtcattatcctaccatgataggataccaaatagccttttttttgtgatgcacaacaatcatacctaattagttaaagatattaaaaattcttattattaaaatggtcctttaatttaaaactaaagcgagaaactacacaaacgggatctaagaatgttcaattgtgtttcttagttatttaggaatattcaattacatcccttaattttaaaaaaattgaattagattccttaatttttagaaatacatcaatgtgactctttacatccaattgaatttaatgtcattaagttgtaaaatttggtagattttgtttataaacagtgatagttatatttattattatttataataaaaataaaataaattcaatctgaaaaaacaaaaggttttaaaagtggcagttttattttaaaaattaaaaaaatgaggttcttatggtgttccaagtcgaacctcgcctattagtccaacctgggcataacccaaaatcgtggtgttccacgatgcaataatatccttcattggcctgtaaaagaaaccacgggaactgtgcactgttatacaaaacagtattcggttggggaattttctcaaatagttggtatgcatgattagtagtggagcctccccttcaaccgctgccaaaggcacaagaagagcagcaacaacaacgatttctcagtgaaacacacccacagtctgataaccattgcgacaaaggctatgatggagtgtttctgtatgagtcaatgtgtttatgtggctaccaacaacgttgcgacaaaggcgcccatggagagcttcttcttttgcatggtgttcaccggtgaattggaaggcgaggacagcgctagcgccaacgccaggaacaaggggttgcacgccttccatggcggtccaaaaaatcttggtttctgacgagaaccagattcctacaactctgtaccgcgtcagctacctccgtcaatctaattatcaaaaggatccaattgtagtatttttaataattgaaagatttagttcaacttttaa

SEQ ID NO: 6140 - DNA, 1000 bp, Glycine max
  Soy_ogl_4742 Gm14:27233701..27234700 Cluster 27
atggaaacaataattttcaattaaattttttctacaactattctttttctgcaaagtaacatgacaatcaaatattttcaattaaattttaaactacaacatcagagtgtttttctacaaagtaaaaaatgacaacaataattttttattaaattttttctataaatataattttttctataaagtaacaaaatgacaaccaaacattttctatttaatttttttctacaaagtaaaaaatggaaacaaatttttcctacaacatttttttctacaaattaaagaatcacaacatatttgctactaaattatgccacaaaaatgacattatacaatatatttctactaaaaatatatgataaaaattaaatgaaacacaacataacactaatatctttattctaatacgggactaatttcatcacctataacaaaaattaaaaaaagtcagtacatttcaacagtaataaaataaattaaacaaactataaatatttaccaaaagtaatacaacttaaattgttagatgaaagcatcagcgtcaccacacccccagcaacaacacaaaaaacacacctcctcaacaacacaaaaatcccagctcaacaacacaacaccaaaaacaacaatggcaacaccctactcggtgcactgcgttttataggcaaagcataacattagttggtgcctcaaatacactgatgacgaggtccagcctagcgcgcgccaccactaggttccaaatagcctggcacctcctgcacctctttccctttggaaggtgcaatcaaactgcaccccctttttcatcatgttgacaatatcgttgatcgcgtcggaaacgataacaagggataagttgcattggttggcgccttctgaaggtgaagggctgtaacagtgaggcgttattttgattgatgcctcctaaatcctatatgacaaaaaaaaaaattcatgagaggtaaacaatttgttgaccaatttagtttgattaatt

SEQ ID NO: 6141 - DNA, 1300 bp, Glycine max
  Soy_ogl_6052 Gm18:16314301..16315600 Cluster 27
cgtttctgcgttttgcataattgcatccctcgaaggcttgaacaggtgccgccaccgccggtgcaaagtagcgtcaccgtcgtggtctctatcaaaccacgatcactgtcttcacctccgttcatactcccatgttgaaccgccgtgaaattatcggaatctgtgcagaacgccgtcgacccttcattttcttctcgctctgcttcctcctcccagtctccgttcgcctccattgccgccactggaatcacccttctgattcaagctcgcaatgttggttggcgccaccattgatggtcgctgcaatgcggtggtgccccaactatcgtgctttctccacgactacgcaacacgtgactgatttagtgggttgctattttggccgttagattaattttatgcttaatggatgactgatattcattaacaggacttctcccgtaaatcaagtcccttaaatactccatgaagcatccataatatactctatatgtgtgagagttaagcatcccataatactcaagtcccataacattgtccttaagagttcatatctcgataactcattcatattttctgatatttcactaaatgacacttcacctaactttcttattgatgagtgtcttttatatgaattctttaatttttagacactaaagttaactaataattgataagcacttgggaaacccatccttttataagggagaaagaaacaaacacttacatttttctatcaaacatctcatattactcaatgtgaaacttaggcatcctataatatcaagtgcctatcacaattctaaactaagcggacttaatggtaagaactaaaaaagaacactaagaaaatgtttgaggtttaaaacatggttgcaaggataaaaccaaagttatatttgtagggaattaaaacatttaagtcttaaaaaaattaatgactatattaagttttgaaaaaaattatttagttactactttaattttcaaaatattttgtaatcaaattagttttttaaaattattaattttagtaacgaaaaaacaattattctttgccgatttgcatttttatgttttaggtaaatataaagatactatcaataaatattgaaaccaagagggggagagggaaattgaaaaaaaaaattaaaaaaataaaacttcaccctccagtcactcaataagtaagacaattgagaagtttaaaacttaatagaaaatatttttttgagtaaaaaatcatgtgtgttttctcacttttaagtaaaaactaattctgatcatgatgtatgaa

SEQ ID NO: 6142 - DNA, 1700 bp, Glycine max
  Soy_ogl_6055 Gm18:16794501..16796200 Cluster 27
gattctgtatattgttttagggtagttgatcagagataattgatttgtttgtatatcatgttttaatttcttattgtatattttcttctagttgcttctcaatagtgatccaataactattaaacacatgaatcatggcttttttggtgcattgcaggtagccaggtagatataaagcaaagtctttcatattttaatacattgttaataaaaatattcactcttaattctttaattaatgtatttggaagaaattttactctattatacattttgaatttttgtattatttttctaataattttgatataaatttatttctctattgcttactctactgggacttgactcatttaatgaatttttttattggaattaaattttaatctttttttttgtggattctaattttctctgaagttattagtttggatttaattaaatgaaaaatatcaaattcaaataaaaattttatttctgtttttcacatgatatttaaaattttgaatcttaaaaaattgcaaatacaatattattcttttatcattttcacattaaattttatacataaattaattttagtataaaaatatacataaacatacacaataaataaattgtgtcccctcattaatattatgaggttttaactttttaaattgtgtttttaaccattccatgtttagctttttgtgcctccttttacaagaaaatacatatatatgttaaatgcaatataaatataatacaacttataatgctcatgttaaaaattattaattattgatatattatttataatacttattaataaacattatatgtctctatagaaaaaaaaattatatatgtcccgtgtccgtgcgccccgtgcatgcatgggtactaaaactagtgtatattccatttggaagcggattgtggcgtgaacgttagggtaattaactttggcttagtttcaactgttggattagattagcatataagattttgacacttcttttattttttaaaactatgtattattattagttacaaaaaaagttaaacttcacactcccactgtcattcatggttgacggtggtcatggaggttgtgtggaggaggttgttctcgagcttgctctggtattgtaaagaggttgatctgggagacattggggttgtcgtccctgcagtcgaagaggaggttctacggcttcattaaaactacaaagatgctgaacataagacatgttcagatgaatacaaaatgggtacaaattcaaaaatgttgaaagagtagcccaagttaccatacaaacctcctatttataaaatcaaacctcttatatcctgaaacaaaatcactacaaccaagaatatcaacacccctttctttactcgtaaaaagcacgcatgcaaagattgaatacattcactctgttgacatgtgtgactgtccctttgtgttatgtaaaaagggtgaggccaagtggtttcaatctcccatttgcagatattctcaccaaaccatcttccacatgtttgatcaaatgctccacacaactagcaacccaaaaactaaatcacactagactccaaaagctgcccacaaactccatgaccactgtcaaccatggtcgagatgaaacactaaattccgtgaggcactcgaggattcttacttggttcagttggttgatgatgtaagaattttg

SEQ ID NO: 6143 - DNA, 1129 bp, Glycine max
  Soy_ogl_6085 Gm18:37792172..37793300 Cluster 27
tgaagactaaacgatgaagttattatacttaaaagattataaatacatggttaaaagtaagttttatgaggccaaataactaaaaccaatttcctcaccaagactgcatcacaaacaaatccaaatacttggaacagtcaccagaattatcaaaaggatggaaagaattaatcattcttgctaatttgcacagcagtatgaatgtgcaaaaaatgtgattaaattttggagatgttgaattatgtcttgggaaaggaagaatggtgattcagtttggcgcacaccaaagacatccagatcattttggaacaagcactagaggaagagcataaaattgcttcacgcgtaagatgacaccacaaaaatcataataaaactaattgaataagaacttgatagagaaggataccatagttttgagcccccaacaaaacaacactgctgagagccatgcacctttgaccagcagcaccaaaacttgcagcaactaaagcatttacagtagcattgccacttgcattaggcattacaaccacatgatttttggcccccatattagcctgaaaacttgaatacatgatgcaattaattaccaaatgccaaataagcccatgagttcctttacttggaaagtttttcaagaaacaagtgaacaagtgaagaacaaaagtttaattagaaaagattatagcatacatgggttccatgaactatatttaagacaccattaggcaaaccagcttccattgccaattctgcaagcattacagaagcacctggaaaaatgccaaagttatgatatccaattctttctgccataagttgcatgtaaccaaaaatgatgaatcatgaaagtggacaacatactgtatatttctgagttctgccagttaagtttgttattaccatagaagcatgctgcacgtaccattacatggatggggaagaaaaactcaagggtggacaataatatttagtatttcattacttgatggataaataagaacacatttatcagtcatcacaaaagcaaaattaatatagacttctcaaactgtaagatctgacattcttcctaatattatctattcagaaattaaatttaataagatgatccatgtgaggcaga

SEQ ID NO: 6144 - DNA, 1189 bp, Glycine max
  Soy_ogl_6388 Gm19:33580928..33582116 Cluster 27
ctcataaaataacacaaaagcaacgaactaatcacttgcgaacaatattaggagaataaattaccagcctatataacctggaaaaattcttatatggacacaaacctaacaattcacttttaggcacaaccattgagaattttacagctaataaaataaaaagaaaataatgccaacatgtaaaaaaaaatgtaacatttgaaattgaaaataaaaaaaagatagagaaattcactctagtgttttaaaagaaaaggacaaactttgtttcctcggtcccctgcattttagaaagaacaaaaatagagagagaaaattggtttagagatgaatgcgttttgcaaatttttgtggcttaaacaaggtgtttgagttagcatatagaagcaaggaaaaagtgagcaaggaagaaggaaaagggacaatggcttcttcctgaaatagggtgttactgtgttagaccagtaaattattttttaaaaattacaaacagataattaatctatactgaatttggggaagggattggaaattaaagagaaattacataattgaatcaaggaatacacagtttgaaacaatttaacatggaggcataatcaacattttccagatctcaatgtttatgaaagaataggaaattataatacaacattgattccatgtttaatttgtgatttcattggcaattagactgtgcatggtgacatgatgtaagtgctgatcggagaccaaggatatataaagcggacgttaagttgataagaataagagggagggaacctgggtttctctattttttttattttaaatgttagattttatatatttttaatttattagctatttttctttgctttagtgtctgtggtgggggagggagggaggttgggaagaaataaaaaagagaaagaattttattaaattagtgaaagccagggaaattcaactgaagttgaaaataattttgtccagtgcggggggattatcccaccttttttccactttcttaaaatttataagaaaagaaaaaggaaaattatattacacaccattttatcccctttttattttttgatttttctttggcaaattaagccttgccagggggaacaagagataagggctaatcggggcaccaagaattaataagcgggactttaagttgataaaaataagggggagggga

SEQ ID NO: 6145 - DNA, 1500 bp, Glycine max
  Soy_ogl_6391 Gm19:33827501..33829000 Cluster 27
aaatgtttctggatcacttatgatttttgagtaaattaattaagaagctcagttttattatggaatcaataatatttaagttatttcagtgggtgaaaacttcagacttcagtcctccttaacctaaacttggtttagagtctcccttagttagagaggtacgtagtttctaggtgaaactaatttggtttggaggtttgtttgtaaaaaaatatggcgggaaagtttcatggggcactaaaaaaagttcaacttaagggacattgaattctttttccatttatgattaaaagttcaacttaaggatacccgagttttgggatagatgtaaacttgacactgatgaaagtatacatccaatgttgttttgagcgctgcattcatttggctatgtaagggtgctgcatattttagacatatacagattccgtgtacatattattgggtacatgatatcttgtactcaatttttaatgaattttgcttatccaaaaaaaaaaatactcaagtttttcttttttcatttatatgattcaagtttaaagagaaaaaaaagtagaaatgaaaaagaaattggaagaagcagcaacactatatcttcgtcttgggtgatatcatcattatttatttcatctttcttgccattccatcatatttgttaagaaattcatttttaaaatttactttttgtacatttcttcttgataaattaagtcaattttgtaaaattaaattagccttaaagttactttataaatttttttgaaatcatcaattttgaaatatgtattactaacactttaatctttaaaaaaatttgtcttcaaatattttgtcaatattgaaaaactgaagttattaatttatttctatgaagatttttttaaaagggtatgtctacagtggagaagtttcaagtggtccaccggtggacctgttaattttacctacaataaaaggtcaaagtaccggttaatcttttatatatttaaactaatctttttaattaacactaattgcttttctttgttttttcatttttcttaaatcattttttgcaccatctgctccctcccttccagatctggattttctttttccgatctacacaagtgactacaccagcaaaaaagtaataatctcattttgatttccattaaaaaaaaaaaaaagtaacaacgatttctgatttcagagtgcaaccatgcatattgactagtatctaaatgagatccatattgactataacaacccaatttgttcaaaaatctcaattacagtaaacaacaaagatactttaatttcctacaagtgcaattttcgaaaactcaactacagtgtacccaactcaaattaaaactaaactcaaaacattccaactctaattaaccattatcaaaaactgaaacccaatcctaggcgagcagaagccggagatgaccaggtcatggaaaggaggaagaaccactcgtgtcagtgttaaaagaaaaccaagaaaat

SEQ ID NO: 6146 - DNA, 1000 bp, Glycine max
  Soy_ogl_6706 Gm20:23563101..23564100 Cluster 27
tttttattgattggaagaaacattggctatttctgcagcatcagattgcaagcattctgatgcctcattaggcacatcctcaacccaaattctctcaccataatcataagccactgctgctaaacactgtgccactttattggcattgtgaaccaccaatgtcagagatgattctgtgccctgcatcatgtttatgcactcatctagaatttcattcaggtaggaagtgtaatcactagtgttgttgtttccttgtgttaatatgttccactgagtgtacaactgttggcaatcggtttcgaaaataacttcaggaaaccagagctcctctgctttctcaatagcccacttgtagcagagtgtatcagcaatttcggaatcataacattcatctgccataaaatatgtacctgcagcatttaatgtaaatacgcctaatagtcgaagaaagagttgaaattaatttagaattttgatcctttatttatatttaggtttcagtttggtggcttatatgaaaaaattacaaacaaaaaataccattttgataaataaaattcaagtttaaaaagttttcgttacattcaaaattgacataattaacatgaaaaccttctgggcaaacaagtttgaaataacaaagataaacaatcaaaattgtaattcaaccatacttaacatattcaaagaaagagttttaatcatatttactcaaacagaattggttctctatgtgagataaatatgatttgtaccaaaaaataaagaaaagaaaagaaattgtacctgatgccataggttcacctttagagtttctaaaaaccactcccaatccggtcccaacatcctctatcacagaagcagcaaagttggccttaattttggaatccaaaggtgggacccactcatcagtaacaaagacagacaaggccttggccataacctgtgcgaaatccaatttcttcttttttagaacccaagcattgcgtttgttccacaa

SEQ ID NO: 6147 - DNA, 1529 bp, Glycine max
  Soy_ogl_575 Gm02:27634501..27636029 Cluster 27
taattttgttaaaaataacctaaagaaaatggagatgaagggatgagtggttggtgacaatgggggagatgaaggcataaatttggaaattcaaaaaaaaaatctaaacgattgatttagaaaattaataaatctatgtgctagcctgcgtcttcgtcttcatatgttatctcacttcatctctcatttcttaccgagaaagtgcccctccagtccacaaagtctttaatcactgtcaccctctccccctcctccggacaccaccttcaccataactgtaccacacttctcgcttgctttcttatgacaaacaatattccaaaattgaaaatcaacgttgcagcaacaatagggatagcaaatataataacttcaatataattctgtcctgagcaaatatcaatagaattaaatcactcaccaattcaacccattattagtgttgtgcgtttgtacttgaagacgagtcaaaacctgtaggtcaatgttttgatgctattgttaaacattatatcttaaattgttgcatccatgaagcaatgacgattctgaaacataataagtattctcttttaactagttaccagggtccttttttgttttttatgtggtagtcacaatcatagccggcgcaatagcgagaaatgcgatacagttacagaggaggtggtgttaagagattgtgtttttcaaaactaaaaaattcaaaacaaaaaccagatttgatttctaaaattttcaaaactttaaactgaaaattttccgaagaagcctaaaattttaaatattttaaaattttgtttctagattggattttagttgttgaaaaaaaaattacaagaattttcatttttttattttattttatcataacgttagatgtgataggcttaaactaaaccaattccatttttattgagttaatttggtttgggtttaacaagatagttgtcagcatcaagcaaaatcgaaccaaacaatttaaaattaatttactttttctttttttcttaaaaataactaaactaaacccataaactaccctaattagaaccactcaaacaattctcattaaaaacattctttaaaacttgtgtagatttcaatcaataagaaaaaaaatgtattaaaaagaaagcataacaaatttcgtaaaagaaagaagaataaaatataaaaacaattatgttattgtacaaaaagaataaacaatggttatgagagtggattgatttcctttttttacgttagtggattgatttccttattctttatgcaaataatgttggtgaacgaccaaaacaaatagtatgtgacatgattgcattaaaaggaaatgcttagtttaatttgctttacatttataagattttcatattatacacacatttaaatgaaaagtagttccattttggtatattatcaagcgaagaaggataaagagatttaggggttgctagatctcaaattaaaggttaatcacataattgacctaaagaattaaagtttatgaaaatattttatgatgg

SEQ ID NO: 6148 - DNA, 1094 bp, Glycine max
  Soy_ogl_865 Gm03:5839007..5840100 Cluster 27
gactaaaagcctatacttcatttttatctcctaaattttttaaattttaaactaaaaaaatcttcttaaatttttttatctaaactctatatattatcaaattttagttactatataaaatttttttatttttatatctaatttttaaactctatttttttagttatatttttgtgaacctcgtataatcaagtgtcactaagatgaaagataaattttttattcattatattttggtttatatttaaaaatatcgttaaaaattaattcatacaaactcaattattaattatttttgtgacatataaaaaataatttatgtgctttaataaatcattaatataattaaatataaaacatcaaattataaatattttatatacaaattaatgatgtataattggtgaacgatttttatgttttgtccgctattatctcagtctggtccatccgtcgtcacatttcaaatgcattgacttggaattaaagatgtactgtgaagagacgtgcagcatgggcaagtaccagcgtaatatttttcccttagagggtatatactaagaaattatcaattattaaagcaaaagaaataggatattgctatttccactgcccattttcatttttttccaacctatcctcagaaaatctcttcgttaattcttccgaacccaagaaaaaaaaaatcccaccactcaacaaaccattaacgccaatccacaaggaaaacaaagcctctgaatctacaagtgctaatcccaaaggtaaaccaaaatagaccaccactaaatgactatatccatagaggttgcaaatgcattaacgtgcaataagtcttcaaatgtatatcccttcacttatgtacacatgataatgcagcctaaaacagagtaaaaagacacagccacccagcccttgaagctgttaccagaaattggagaacaaattttataaatctcgcgcacattgctgtcattgtgctcgcgctcatgtctcaacgaggttgagaagggcactcgcagtttggagaggcctcaaatgggagtgtgtttttgtagaaggtttttccccgaagagaattaaataggagggac

SEQ ID NO: 6149 - DNA, 1200 bp, Glycine max
  Soy_ogl_2042 Gm06:40834701..40835900 Cluster 27
aatattaataataaaagttagtaggtaatttgtgaaaataattgtatatatggcattagcattatgatgtagttatagcgataaaataaatataaaaatgtgtacaccatgttgtttttatatatagtcatagataaatgagcatcggaaggtgagaggccataaagccaactatgtgcattatagcttgcaggatacgtggggtaatttttaacattgtttaatagtgtaacaaaaacctcataaaaaaatactgtaggaaaaccacttggctaaggctaaggcatgggtgcatgggatagttaagggaaagcaactactatgatgtgggaaaagaatgcacgtaattgtagaatagatttctaagaattgaaaaattactaaaataatgggtggtgtgtctgtaacattcgaagggaagatggaaaactgatatatgtttttaaaatttagttatcatgggagatatggctatggttcctgtgtaaattgataaatgggttttaaatgaatgatgctaaaggtgttgcacgtttaagagtgcttcacaaatttagttacattcaaattgaaatgggcgggtgctcttcatgttttatggggaaatagaatttttataatttaagttataatattctatggttaaaaaaagttatattctaataaaaggaatcggacaattattttgtgaaaaaaaaaacggtatgttaaattgtaatggtttaattgaggtttaattacgcatataatttttaatccctaagtttatatgtaggaactaattaaaaaagattaaaattgtaagtgtgggatctaaaattgatgacttttaactaagaactaaaataataaaatttgtataatcataaatattaaatgaataattaaacttttaatatgtatatatgagctagaagatgacacttgcataatatagtaaaattaaatcctgatttaatataataaaataaaagtgaattagatattattaatatataaatgtttagcttcatattttagtgggtataattttttaacacaatacacattaaattgggaagtcaaatataaagataaactgcactattttttccaggacgaggctagggtgaagtttgcaaaccgtggatcacctggaaattatatattttgacctgttattgctagttaactgggattaatgaccggcattgttgaatt

SEQ ID NO: 6150 - DNA, 1400 bp, Glycine max
  Soy_ogl_2817 Gm08:37539901..37541300 Cluster 27
atgataccttgtacaagaaaaaggttctaacttaggaaacgtcacttgtaagggacgtttaattgtaccgcttgtgtcccatacaaatagattggttgcaccctccaatataaaatcacttaaaaaacattataaatcaatttttgttgtgaaactttttaagagatccacaaaattagaaagttttgaatgtgatctaatgatatacaattatgattaaacactgcagtcatataagagaagaaaaaactgattggcacaacttttcaagctgttaaccgaggcaaaacttactggtacaacgttacgaaaaacaacataataaaataatttatattgactgatttaaaacaaccaagcatgttcaattggattaatatacctaacccataaaactgataagcaccgaaagtacatatttatatataatggatcccgataatagatataaacccggatatgcattgcatatgagacgaactaaataagttatggcagacaattctctttctaaggttcgattattattttagttctttaatttattttttaagtcaatttgatgatcttattattataagatttacttaagttttctaatttttaaaaatattcaatatcatccatttatttttataagaatcaattagatcctttatttttaaaattagtttaatttaatcctatttttcttttatttgcttcaaaaattttgaaaaataaaactgaactcatcttaaaaaataagagatctaattaaaacatttttaaaaaaaggacctaattgaattacatctaattgaacgttttaataataagaggaaaaaattaaatttagaactgaatttgatttataatgaaaccaaattgaactcatattaaaaaataaggatctaattaaaatattttaaaaaaagaacctaattgaattacttttaaaattatagaatttaattgaatgttttaataataagaggaaaaaattaaatttagaaattaaattaaaagattataattataattaaacctagagctaaattattcgataaataattaataattatcaacaagtgaggcatcatgaagtaagaagaataactcgctgagctttatgcatgtgtcagctttgtggtgtcgcatctaagtgcctctatgcacgtgtatttctgacagtgttagttgtggaaccaaaacagtgataagtggcgccacagcgcgggactgaccaagctttgagtgaatatagtgaccacagttttaattagtgctaggtgttggtatggatatattttaagatgtaaagctagccatatgatattagtagtcttatgcttggattcatgattcatgatcatagtactatagtagatattcgatcacaagcaaacgcgagatccaag

SEQ ID NO: 6151 - DNA, 1058 bp, Glycine max
  Soy_ogl_3891 Gm11:32563601..32564658 Cluster 27
aaatttttatattttataaatgaaggtatcatgaaaataattaataatattattgaatgcatatgtgaaagtattgaaaaatcattacagaaaataaaagggataacattttgctgagtcaaaaatttatttgaatatttaataagtgtgactccgttggcatgcatgttttgtggtttaaattttcacataacacatctttggagagagacaaaagtttaagtgttaactaatgcaaattaaatattagtctttattcgtaccaaaggatgaaagctggtatagataccttaaaatcttatcgagagtcaaaagttctaatttcaatgttttaaaattaattctcaaccagatattctacatttgagagttactatatatttttaaaatatattttgtaatttatccaaaccaataactaatcataaaagtaaagaactttaaaaaaatgacggtattgaaaggaaaaaaatattaaataaaattgataagataactcaaatttattttgtctgtgcttgagaatttttctttaaaacatatttttttgtaaactctaaattgttgaatacaatatttacataataatttttaatacaaattatgaactaaaatataattgtctcatgtaaacaaaccatgatattttttacatgagacaattttactcaagtcagattaataactacacataaattttaaggtttaactatctagttgttttcattttaagattttatgaaaaagctaggtggtgggaagagcaaaactaaaaatgagaaaagcaattcccccgaattgggcacattggagatagacatcaaaacccaaaaccaatggacatttgcattcaagattacgaacctcgaaacttaaggcccatttgtttcttattcaacgttcattttaaatgatttgaccacttaaatgaaaatgaaaattactcaattgaaaattaaatgtttaataatatctattgatagttcacatacattgtactgatcactttttccaattcatatgctattataaagaaaaaggcaatgccaatgtatatg

SEQ ID NO: 6152 - DNA, 1298 bp, Glycine max
  Soy_ogl_4033 Gm12:11586003..11587300 Cluster 27
tgggaatcgtggtggagcctcaaacgtaggttgtccaacgtatcaccttagcgcttctccatgcagtcgtttgatttatcttgaaatgtgtgtcactacaaaaacaaaaaaaatgacaaacctaaatactcttggtttgtttaagtgtgtgtttgaacttccggtccaaacttagattaggaccaaccttcgtttccagaaaagtaccaattgtcttacttttactgtaaatgcgtgttggactttgtgcaccacatgtccactgtcacactagcaagacaaacacatcttgagtctaaaaagacttggggaaagaaacctcaattaagtgattgaacatgtacggaatgatcgagatattgcctaaagaaacaagtgttaaaaaaagtacttatctgcatgtttttctctgcttttatctttttattacactaacaacgcaaaaactttcaaaatgttactgaattttattctaaagatttttataaaaaccgaccaccactcatcggccgatacattagttttgtcctgcatggttgttcaattttttgaagcttatagtttgtctatttttccacgtgtttgaacaagtttttcgaattttttaaaatataattcaattttacttcttgtgtattcttttgtctttacataacacaatattcataaatatgtaatattaaaaacttaaatttacttataaatgtcttaattcggaaatgcgtttgatatatactttttgtattgtgaaataaatgaattttggttttaatccttctaaaaattttctttttattttcattcattaaaaattgaaatcattatttttttttctactctcatgtaattgaagaggacaataagtaagatctaagatctggatataatattatagtttggtatcatacttgtagttcaaaagaaattatattcaatctcacatccacatgaatagtaactttaataccaacctcttttcccgttaagtatctaaatactcgtacatgctatccacactttaattaatatgaaaaaataaaaaaaatattattgattaaaaatatgataataattaaattaaaattacattcaaagatcttttataaaacataatcataatcataaaacatggcaagttaaatcttattcaaagatcttttatagaacacgatcttttagtaaatatggaactttttttttttgttaaatgaatgaattaatgaacgtgatctatctcttagcaaataaagactaataaatataattttgttatgaatgaaggaatataatttatctct

SEQ ID NO: 6153 - DNA, 1066 bp, Glycine max
  Soy_ogl_4197 Gm13:22025886..22026951 Cluster 27
gagattaatttaacattgtatcatattttagtgaccaaaatatgtgtttatccataaatttataataatttttactagtaccaaagccacttggccttcaacattgcaggatgcaacgttccactgtcctaattgcttatctttaaacaaaatcttctagcaacaaacaaaatagacatcagaaaaggcaaaaattaagcacgtcaatagatagaaagaaaaaaaaaatctgaagtatcaattcatgtatttggtttcctttctttgatatatattcatcattcatgaatcttgtacctaattaagcatctgcatgcgtcccataaacaatacggtgcacattcaaatgcacaagttgggtgctaattaagtgtgggattaataaaatgccttagatcatagtagggcctaatgccggttagcttaagagcaagtggctcattatttaactgcaaaagctagtttatttgattcaaggcattatataaattgaacgctttcgtgcagttttttttttatttccctttttaatgatggagatagataatgatgacgatattaatttggtgattgacgaacaaataaaagataataaaaaaataataagaggaccaacaagctatgaacagtttcactagatcctctctggctgctccgctggcaatataaaaaacacaaatatcaaaacccaaaaagttcggggcacctggcacggacaatgctgcatgcgcatctgcttcgagtgatctttaattaaaatgtttcgaactttcgacatgttcattgtacctgttgctgtgttgaggattttcaattcatttatgccccagccaactgcttcccagatatatatgctaactaattctactctttgacccagaaaatgagcgagggagcatgcatgtttgaaattaaaaacaaaattatactaatagatatacttttgttcaaatcaatatttttaaaattcaaccggttacgaaattggtgaaaacgttgattcaagatttaataatttaactgtgatcaaattgtactcaaaccagcattaatataataataataa

SEQ ID NO: 6154 - DNA, 1173 bp, Glycine max
  Soy_ogl_4745 Gm14:28797928..28799100 Cluster 27
cacataattatacaaggaacgattacatataatatagatagaattatatataaatatgtaattacattattaataattataaaagtatctgctgcgggtggatataatggcggagacgggatggagagtgacatacctagcctcgctttcccaaatctgagaaaagtcgatcccaactccaatcaaagcaaatttttcttggaaaactcaagatagaatcggaaagtaccacatattcaattttgattggcatgaaagaaaactacacgtagaactcaaaatgggtatacaaaaatttgaatgttagaaccatctctaactcttcaaattatattaatattattatgtatagtctcccaagtattattatatattccttcctacaaatttaatttatccctacatgttttaagtacaacaaggagaatgtcatttgcacactcattttcacctcacaatttgtacctataaatgatcgtgattttaaatgatactccaaccaatcttcagcatgtgaaggtttgactcagattttgaaacgccccaggccacccatgtccttattcttaggcaaacacaatattggagaggtgctagcaagatgagtctttcttttaccatgactagctccatatgaaggatttacatattggcggtagtgtcatttgctctatgcctctatgtaagtcaaatttagtaaagatgaaactgcattaagttacactaatcaaataattcatcaatcttttcaataaaagaaaaaggattatagacagaaaatgtcaaaaaatttatactattatttaattataattcatcatatataataaatttattaatttttataataattagtttaaaattatattaatgacaattataattacacggcggtgcaaaaatattttatattgtctgaccattaatttttaatttagccaaatgttaaccggcacctttgagatattaattaaaaaatttaaattagaaagattaggatgcaaaaaattagattatttatgattttttaaaaactttcatatatatgattaatacactaaatattttcttctttttaattcctaaattagtgttttaaagaccttgcttaacgagatccatatttttattttaagatatttaaatcttcattgaaccgaggtcaaacacata

SEQ ID NO: 6155 - DNA, 1000 bp, Glycine max
  Soy_ogl_29 Gm15:17194301..17195300 Cluster 27
aatttcatccaaagcaaacatgtgctagagctctttattctataaagtttgaatgctaattaggttaactaagcttatatttttataaccttagactgttatttcttgtgtttttcgaatatgctataactaaaaagcagaaatttctgagtataaatacaatttctaatcaaaagcatgttactcttcaaggcttagtacaagaaggcagaagtagaagtgcacgcaaaagtagaacacacttttagagaatgtcaatatctttttggaaagaaatcacacctacccgatccttctctttcctttgcaaaagtagtgatagttgtcatatattcctacatttttatagccattttggtgcaattatgagatgtttcttatgcttttgaactttgtgtgtgttgatttttatttatgttttgaataattgttttccatagtttaaccttaaattttatttccttctacacttgatcttgtttattttttgtgagttttgaaggaagttttggagaagaacttagagctctatcaatgacattagaggaaaaaatgaaggatctcaaaagattcaaaggagtcaaaaaagagctaaaaaatgttgaatttagttcttggaaaataagcacgaccccttccataacctcatgcatagggcgtgcagatcagtctccgcttcaaaaattatgcaggccccttgcataatatgcacgaccatttacataactccatgcatgagacgtgcaaattagtctagatctctacttcagaaattatgcacaaattagtctctacttcagaaattatgaccagccccctacataatatgcatagtcccctgcatacccttgcgacttagcaagcccattaagcttataaataatttaggtttagcttttgttgggaaggcagattctaggctattttaagagagaaaagcttgtggtagcatctatgcctaaggattcttctccatctttttcttcatcatcaaatttta

SEQ ID NO: 6156 - DNA, 1394 bp, Glycine max
  Soy_ogl_5071 Gm15:17575401..17576794 Cluster 27
taatccacgtatttagtagaaaataattttttgttagcatgttagcaataattaagcataaacaggcatacaatacaagcggtaaactatttattaataaaggatcaactacagttacattgtaatattattattctcgttgtctgatagaatcaacaagttactgtttttttttttttcattttttaataattattaaacaatgaaatcaaaatattcattttactaatttgagccaagattcctaatttttcacatgacatttagcatttaatatatatcatgatgttgactaatttggtgtttcaagttatatatgtcggctttaggtgacgaagtactgtggtatcaaacttcaataataccatagtcattagtgtactccctcttttgttgtttttaaggtcgtattcttcccattaattacttcacgttcaaatgttgcatataggctttagtattagaagaaaatagggtggccaataactaagtgataatgaaatatgcttattaatatatagatacatctagcttactttgtatagcatttccattgacaacaataactaacactttgtatatataaccaactttaatccatttattcattttgaaaggtaattgtttatatctttggtacctattttcgggttaatagtttcctgccattatagtgtccaacaaaaggtgagctgatcaataaataaaaagttccaataaaacccacacaatactgttaattatagtccctgttatctatgtttatttaaatgtatcttcctgtggaaagcatgctaaatcattaacaattatgagaaccatcatagataattagttatctatttgaattatcgataagggacaaaccaggaaaatatggcagagtatgttctgattatagtcctctttctctattcctgaggcaggtaattattagaggatatatattgtgcttataaattactacaataaaaaagctagacaggtatttgatgttttggtcgtgattgataatatatttaagcggaagtgaataatgaatgattgctcgtgcatgccaattgtcaacttggtgatgatcagaattacttatgtaaaagtttctggtcctgcatgcgtcttattagctaatgcccttacgatattggaaaagtaaataataatatgaagttttaatttttgtctatctcattttaaaaaaatgttcaaaattatttatagcttcaaaatataaaaaaatattaactacttttttcataatatcctaagaaatatattatagttgcaattatacagtgtgtaattaattataaaataagactagtttagtgagaaaaaattattttatcatgaaaattggtactattctagtttcaaatataagaaaatttcat

SEQ ID NO: 6157 - DNA, 1000 bp, Glycine max
  Soy_ogl_5093 Gm15:33940001..33941000 Cluster 27
aagcattggctttgccttggtaaagttttgcctaaactggtcttcatgtggatgagtttacctagtgtttgggtccaagatccacttgagacactgatcaggacaaagttgatgccttggccgggtttagtcaaagggtcttacgacaaaaagaaagtgtgcatagtaaaagacaaatgaaaagctcaccaaggatcccaaacaagttatcctatactaattctaagctagattagtgcttaacaaaacatctgtagaaacagaaatttgaggtctgtgaacttttaacaagtatattagttggttcgatggcacaatatgatgcatatgtggtaattagtgtcactctcttaaagtaattttcttggtatgccgcaatatattgagtgtaaaggaagattgtcgcctcggtcccaatacattcttaagaaatgcatagtagtttatataataatttaagatatgcataatttatagtatcttgtcatggtcattgtagggaaatgtctaatcacgtcaaatacataaatagccgtgactttataatgtcgtgaagcaatccattcccaattactacaagttggtggtaagccattcatttttttttatagatagcttgtctattttctattgaatgaatgaagttctcagctctcactagcaaattaagtggaacacatttagaatacgtcagaataatcaacgtggaataagcatttccacacaaagaaaacaaggtctctcacaggttacactactaagccatcataggaaaaaaagttatgggcattttggaaaggtgagaggcacaatctatacaacaagaagcagtaatacatacaaatcctttcataggtagaacagtaacatgtttctccaatacattaacttttgttaagtagtgtaaaactcgagccatgtcttttaatatatctactagtaacttcctctagttggaagcacctcaaatgcttatagcttcatcataggactaacacaa

SEQ ID NO: 6158 - DNA, 1400 bp, Glycine max
  Soy_ogl_5359 Gm16:27114501..27115900 Cluster 27
gcaggccgatactgtgaaaaattaaaatgcttttttaattgagatgggagagacaaaactaaaaggttacacagagtagatggtaatgagaaacggagtttcaagtaagtagtagtcatagaaatagagtgtggataaatggaataaggaaaaaaaagatcgagaagaatcataccgaagattgagaacgtattgttgtagtgtgatgcactgagttagaagaaatccatgcatgacgggtagataaacatgatatgaggacacagaatgagagagagggaagttttgaaaaagattggaacaattactgcacacacaccccaatggaaaaaataacaagggagatcaataaaaactactgtattgcttctctttagtttaattattttgtatttctgttcacctttgtttttgtagtttaattttatccttttaactgatagatgtattaaagttgtacgattaaaagagaaaagagttgcagaataatattaaattaatatttatatatacacatcaatgtattatgaaataaattctaaaactattttaattttagtgaaaaaaatacatatagaaatacagatacacactcaccacgacgccattattgtttccactagtctattactaatggcgtctaaattcctctcagtggagagtggactcggaagattggcttcggtgcagaagatcggttgttagcaggtgttctttggccatttttcacacaacgtgaaagtagattgattagtgagattttaaatactaaaaagaaataaaaggtagaaagattagtgcaaatttcatgctactactccatttgtacatagcaacacaacaccatgcatctttgcaccattctgccaacactacaccaaaacacagtagcagattatatccagaaactgatgatgataaacaaaattgaacctaaaatctgaagttggataaatattgatagatgggacaccaaccacataagggagagaaagagataattgattccggtaaaaatcaaactcaggaacagcattaattagacggagatgaaaatgtgactggtgatgccatatatatacatatatatatccatgctgcataaaaaaatttacattgatatatttcagaagatcaggcccataagaatgcgttagcataatagcataattgaatctgagaaatttatcaaatggctgaatggaatatgaaaaaatttggaaagtaaaagaaagttaaaagcataaataaaactgttactaattgaagaagaggcaaggagtaacaaacctagagtaagagagaaaaagagagttatagctgagattgagactaagtgcacaaaattcagagaaagaaagtgaagagagaaaggaagaaaagccataaaaaccgtagaa

SEQ ID NO: 6159 - DNA, 1200 bp, Glycine max
  Soy_ogl_5707 Gm17:19696201..19697400 Cluster 27
aaggttaaaattataagcaaatcattatgttctttcaacgcttttcatctcatttttaaggaaaaagtgaattgcttagttccaaacaaatttagtcactttcatctgaaccaaacaataggtaaaattctcattcatcttctttctacacaatttcaatctcacttctccactttcatgtcaatcgaacaaggtgttaatcatttgacttttctttccccaatagtactcttcctccatgaaaataatttgtattacttttaatcaatcaatataacttccatacacgacttttttctacctcattttttttaacccaacattatagtgtttggtcctgctgaaaattttctctaagttgttttgtcatttatgattcaagagaggactgctcggcagggaactttccgagagcagggcttacaaagggaactcaaattgaaatgctttcaaagtaacttggcctattgatcttgatggatgatgatgcactattatgtgcattgtaaatgttcaaagtctaacacgagtcatatgagtatattttatcacatgttctttaatctcaaattaatattagaatatttgtcgatccctctcgctaataaactaatcattgatatttattgatgaaaaaaattacaactagtggagacgtgtgtaatcaatgtggtgagaaagatttcatatattggcgagagtcatctgaataatctattgccaggatacatcgtcctactctgaaattggaggagtgcaatttagcaattaaaaagatattttggggaataaaaaatgagtttaaattctatttataaaataacgtaactaatatatattttaaactaatcataaatgattaaatgatttttaacataattattataaaattcaataaatttattatcaatgaaagtttatgatcacatagtatatactgtttaattagaaggaaactagtctctataaatataaaatctgtccagcaataccatgggccttatatcaggccattcagctaggtaattccatctcaacaacgtctattttgaagtgaactcagattttagaagaaaatttaatcagaagatttgcttctcaaacagcaataccaaatattattaacaggtgtcgtttatcttttaatcaactttccaattttggaatgaattttgtaagacgacaagcgaatctcataac

SEQ ID NO: 6160 - DNA, 1293 bp, Glycine max
  Soy_ogl_6044 Gm18:15631101..15632393 Cluster 27
aaataataaatgaatcaatccattctcaaaatcagtgtcgaatgttttctggggaaagcaaaaataaactggttcaggagttgagagaattttataacaaacagatatggtgcaggctacaccgttgcaaggagaacagatttacaatatagaggcagagttcaacttccacgagagaggacaaagtggagactatagacaaagatggaaagggacacactagagtgactcgcggatgcaaagaccaaagatggcataaacggagactcagagagattgtaaagtggaaatggcacagacgcatagacttgttggagattgaagacgaggacatagagattgaagacgaggacggagagactagagccgcaccgctacaaggatgactctaagcattccaattccgtgagagagtttcaaatttaggattttaggttaagcgtttcacttttacgagagaggagagagtgaaagtctctaaggttaagtgttttagatttactcagtgtaagtattgttgtttcatttactagttggatgtcatatatgattgagacctacaaaatataaatacattaacgagtgcgatttgattcagtttacgtgtagtgaaccaaagtggatcgcgtggtttgaaaaaaaaaacaaaccaaccattgagctttggtgtttttgtggttttcaaatttttcggttgattttttattttttggttcggttatgaacaatgctacttttgtggccaggggagcaacgaaaacccctttggtttaacacttttgaaggttttttttctttttcttatcaactatatttacttttcttagtcatgattgcatgttgtaattagagttgagttccggcctttttatgtgcactgtttgatcacttttgggcctggatggctaatctattttatcaaataaaaatgagtttcttttgttgttctgattcaaactaacctgaaccttaaaatctattgaactttagtaaaaaattaatcttcacgttaaaaaagataatagaatgaaacaatgagtaaaacatcaaataatataatagataaaagataaaacatgtctagaatatgagttagattctattctattagttaattattttgtgattgcagtaattgaaaaaatattttttcttgagaagaataataaagatttagtaataactgcacttccgacttagttgttattcgagtcataaaaggtaatttgattatcgtgaaaactttttttaaatatgtaaaaaaccaaaaggattagaatgataaagaaaata

SEQ ID NO: 6161 - DNA, 1161 bp, Glycine max
  Soy_ogl_2362 Gm07:18979040..18980200 Cluster 27
gataataatatattattaataagttgttaatttgagtggatttaggtttaatttccagaaataaatacggtcttgagttttaatattatgaattaaaaaatgtagttgagaaaatatcatactatagctgatcaattaaatttttccaatggtgatggatcatcagaaagcttgtaaatatttcacataataacccataaaaattcacccattattattattgatattttaatgtatggaaatcaaattattttaaaatacataattgttatatttagttaaaaataatcaaaattatacatattgatcttataatgatcatgaatctaattagtgatgttcatgattttaacattcaaatattacagaagcaaaccctcctctcatacaaacgtcaggttttgggctcacttatatttttcttcgagtactttttctgatcatgtatcttatcagttccatagcttattttaaaattaataaatattattagctaactttatcaaaagaagcaccagtggtctagtggtagaatagtaccctgccacggtacagacccgggttcgattcccggctggtgcattttcttttctttttttcagtatttcgtatacttaaactacatcaccaacaaggacccaggagttccaccaaataccaagttcactacattcatatctaatagaataaaataacccaactagaacagatttattttactatttaacaaaaggatgttaacattagaatatatccacgtttataccatctatagaaacgtcgtatgcttcccttttccttgttttcttcatcccagctacgcaatggagctttgatccttcagatgacttttacccatatcagtacgttggtcttcattccttgtatgaaggagtgattgaggggtagcttattttgatttgatatgtaagatgtcaataactggagaaaggaatgggtggagaagaatgtataaatcatctttgaagggacttagcaggttttcaagattcataagagtgggatgctaataaaatcaatatgtaattcgtatgtactaaagatcaaatataaaagtccaaaagatttttgtacaagatgacttggtcatacatgaggatgcatatcttacaatgcatgtttttttttttttttttacat

SEQ ID NO: 6162 - DNA, 1300 bp, Glycine max
  Soy_ogl_5055 Gm15:15127301..15128600 Cluster 27
tagaaaagttttgggcatatataactcctaagcaaggaaattgcttcttgtactccccataatttttaatatccccaacttacttttctctccttgctcactctcttatctctattttcctcttcctatctctcactccattgcacctttacacaatcaatcccttactttgtgcctctccttccttgtgccgccaccacaacatcctccacctccgacatcgctccaaccacgttaatttgttggaaaaagtcttttttagggtcctgatccagtggaacgatgagcttgaagagactccatctatccttgaacttgctcttctccttagaattagataagatctctttctgctttgtcatcaccttcttcttctcatatgagtacatctgcttcttggttctcttcacacaccaaatgtggtgtgtataaaggactcctccatgggtgggatcgcgaagcaagagagcattatcactgtggtgcaagtcatgtaggcttttacttcctagatcagataaccattccaaattgagtaatttaaaacacaagatgcattttagattacttaattcgaaaatatactagcatagttcgagaataggtgatctggaagtcatgtaatataattccagattgagtaatccataatgcatcttttgtttcagattactcaatccaaaactttgctacatgatttatgcattgtctatttcaaaattatgctagtataattctggattgaataatcaagaatgcatcttgtgttccggattactcaatctagaatcatactacataattcaagataatttattcaacaattttgctagtatagttatggattgagtaatctagaacaaaagaatgcatttcaaataacttaatttgaaactatacaaagggagacaatagacgctgagaaagggagaaaaagcaaaaggaagcaagaagatgaaatggggatgaatgaaggtatatgtcgaatgaggagaaagtgagggagcaagttgtctaatacatataatttgggaattttaaaaataggaattgcaaacccccagtgaaaccttggacccaatatcttgtagcactctaagaaaagtctgtagtaggcaatggacccaaatcactagaaggtttgtttgttttctccaagagtgtttgggtttctaatccgtacctacttcatattttacacaagatataattgtgccctcccaaaccattatcttgttgaactgattgataatcgtgctcattaagatatgttatcaagtaccaaaaaaacaaataaaaa

SEQ ID NO: 6163 - DNA, 1171 bp, Glycine max
  Soy_ogl_5108 Gm15:42361610..42362780 Cluster 27
taaatgaactcaaagaagtattgaagaaatttgataccttagtttgagattcaaattcagcttccaactcacattcaaaaaattcataatctattacattcagtggatcttctgcatcgaacaaagcatctttgacctcatcaagccatgctttcctattattatcaaccatcgtccgcaacttctccttcaactttctcaggtcatcgagttttcttcgccgaaagaagttcagaactggacgagaagccaacctgtcaattgcaacctgaagagaagcagcaacaattgcaccaacaatcaattctttctccatggtagctgcaaaaggaattgtgcaatgaagtcgatcgccaggttaatatactgatgctgattttgtttttatgtatttaggaaacaacatagaaatcaatgagtagggaaagttggtccaaatttgagtgcatcgtaatctccgcgactgagttgaaagttctctgacttatagaggattttttatacaatctatgcgactatgctaattgatcgattctatctaagaactcaatacttcgaaacaactggaatggatttttagcgggaaagtcaccctgcaattcctaatatttggactgttgaattaacatattttactaaacttttacacatgattagtatgaacaagaacaattctgtctgtgtgtgatttatgaacgttctcttttgcgcttcccacaaactagaatcacactttttttatatcaaaatattaacaaatgtttaggattcgataggaatcttaagctgtatgcattagaaagactttagttaaaagaataggatttattatttttaatccaaaaattttaatttcaaattaataattgaagaattttaaaaagtatatattttggtacaaaagtatcaattttaacactttttagaaggaaaaaaatattgagcaatgttaaaaatttgtttaattaccaatttgtcacttaaattgtagaaaaaactcaatttgatctctaaatttccaaacactccaatcagtttctttaatttttgtaaaatggttcaattagatcatttttctcaaattcaaactaacattgccagcatgagaattatgacgacgtttttcatgcatgaatagtggtggtttttaattattactatatttaggtta

SEQ ID NO: 6164 - DNA, 1500 bp, Glycine max
  Soy_ogl_6054 Gm18:16580301..16581800 Cluster 27
caatatttttttcaaaccattttatttgcaggattaataacaaagttgcatattcatgcctagctggagttgataatcgactcttctagtttaccgttcctactctctaataaattcttgcatacacaaagctattattacaaaacaacatctacacaacagtgacaaaataaagaataagatatatacacgtcaatcaagccaggcatgacaacaactccataatcaatttagacttcccctgattaccatatccctcaacgaaagatattattttcccttcatttatctccattaacaacaaatggtcaagagaaaaggtgttcttcactactaatgaattggtgctagtgccactcaagtgagtcctaactcgtaagaccctcaacctcacttttctttttatttaactacaggtatctttcatgattgctagtcctgctctaaacacgttcaaacaaaaattcctctaccttcacacaataatctttacaacctcacaggaaaaaataaaaagagtaaaacaaaaaaatacaatgatcaaggtttagaaaagtaaaacctgaaccagaaatgatcctttgtggggtcacaatgcatttgctggatatccagaagtgacaatagggaagaaggctgcatttatcttcaaaaaccgttgttaccaaagaaattaataaaatttaatcttatttaagtagtgaaatgtgcagtaaaaatgagcaggacacggttaatggtttagctaggaggaacatgtaacctacacttatttcaataccgctttggatgaaataacatccacaatatactttccaaacattttggagaatgctgcttacctaatttgcaatacactgaagaaaagccaagatgagaaagataaatcactgtccaaaattgatcaaggaacctgctagtaacatgccagggagagaagcattatttgattatcttctttcgtcactcgaagatgtcattatagacaactgtaccataaatcaggtgggcagaaacaggtacactgttaaccaactcagtgaacaacaattgatatcacactaggtgcctgggaaggatgtctactgtgacatccattatctttataactactgtctactgggttatcctgctgaagcaaatcctgatgtgaagctggcagctgagaaaattttgaaaaataagctttttttaaagtcgacaacctcatctgaatagattttttgttttcattggctaatatctctacaatctacattgagaacatgtcatatatgtgatactttggcacattgagttcttttacaaaaattggttgatgatgcattgaagaattttgcaaaggttgaatctcttatgtgaagaatgcattttctgtgaattattattgctttttttttctgttgtgaattattattgctgtttttaatgaatcagttcaatcctagatcattgttcttccaatctctatttgattcaactgattcagcttcagttggg

SEQ ID NO: 6165 - DNA, 1000 bp, Glycine max
  Soy_ogl_4309 Gm13:27607901..27608900 Cluster 27
attgctttattttttgaattttattcgttcatttttttttatctgcaagaacaagaaaataactattaatgacatagacgataatgtgtataagtgatatccaccccttacaacatcaaggccgaaggaccaagtctaaaaccagaaccgtacccctcctatagctgatatgatatgtaaaaactccaattgtctaacccaataaaaaacctcataatatcctatgccaagtagagagtgaaatgcttatcacatccatatttattcattcattctaaattatactgtagttattagttttttagatattttctttaaaaaaaatatatttttcaattaagaatttaatgagacattttaatgagtcacatactctcataagaaccatccctattgggctatcgtcaaatttgataaatatttttatgaaagttaaaatttattagtaggtttttaaactattttttaaaaaataattaggttcctatctttttaaaattgtaattgggttctttagtttctaaatgaatttttgtaactagtttatactgacttaaaattgctataaaaatacaatttatggtgatttcaaaccctaaagactcaactaaaaaattcatttggagacatctttaaaaattcataaataatttaaaaacctaccaattaatttaaccttattagagcttgtaaatgagctcgacagaaaatgaaaaaagttgtcttcctagggaggaataggcaaaatggagggcatgggcaccaatgattaactaacgtgtcacatttaaagcaaccaacagcttcaaatttgcaaaggttggcgaaaagaacttatatggtgcaggctagtaaagtagtataaatatatgggtttgaataattaatgttttttgtcattgcctcactgataagaaattttaaaaaatattattatgaatattaaaaattaaataaaataatcataaacaatataattttacaattttttaattttttt

SEQ ID NO: 6166 - DNA, 1959 bp, Glycine max
  Soy_ogl_1326 Gm04:39590301..39592259 Cluster 27
ttgaaagcaattttgtttgaactaagtaagattactatagataacaaaattctctttctaaatatttaacacagctgcatatccagacttgaatcaaagacctctgattaaacttgaacaatctcacgtcagttaatgtacatgtttgatggtttactatgtccatctaaaactgagtaatattacatacaattaatatacaaataactgaagagcgtgtaatgaaagaaaacatgtcaagattgaagctttgatgatgaagctcttccatgcaaggggcctcacagtcacagggtcagtaatatatatgctgttttcttaagcattaaactctattcccatttacccttttgtctgtggttgtatattaatatgaaattaaacaagtcaacgtctgatatgttccctgctgctgctgaagacccatatcattgaatatgatttggttttggcctgatagctgctctcagtgccaataattgtttctcatcacagtagtaaactgctccaacagcctaagaatgatacatacgaataaaacaatgaaaatgatagcgttatggacaacattatttttttacatgtgaagtctttcggatttaaataatttaggtgtattaaattgtttttgcttgggacaaactaatcacaacatcacaccataggggcataatagggcaatgtgcaatgatcattggaaataggctggaagtacctgtgttgtaaatacttcgacattcgagaataattaagaaattaagaatgtgggtaaagaaaaataaacatgtttgaggtaaaaaaatttactaatagagttagggtcttctaaagttgtaggttaggtttatgttaatggacttgtgttaattcctgcttgtgaaaatttgtttcaagtataaacatggacagttaattaccaccaataaactgcggatcttcatgttttaaggtaatctttcagaatagcattttgttgacaaaatgaaagactaatcacttgataagaaaagagattgccagaattacgggaaaagtaacgagaatgcaaactgattggacgtaaactaattagaaaaaacatgtgttctagaaaaaacatctgagagggtggattgtggcataatctatgcattgtgactatcaatcataataattagttttcaatttctttaattatttagccgtgtaaatctgttatttccaattctgatttgttgataattattaggagattggtagcttgattcactatatattagggctgttcacttgtatatatatcactgtaaattaatatcaaattcatcaataaaagttacaaacttattcctctatatggtatcagcctaaacgatccacccattccctatttcttcaattaaggacgtcgttccccacccttgcctcccatggccgacaacaactccttcattcccaacccccatgagccatccaaaccccttgcttgcatcactttcaccaatgtcaccaaacttcttcccaacaattatcctaattggaaacaacaagttgaagctctccttgatggctatgatctcctccaatatccagatggatcttttcctgcgccgtcggaaatgacccccaccactgcatcacttccggtaacaactcagaatcctgcttaccaaacctggcgtcgacaggaccgccttatatatggtgctctcctcaccattctctctaatgaagtggcctccctggtgtctcacaccaagacctcgcatgatctttggatccttctcaaaaacacctatgccaaagcatctcacaaaccttttcttggccgctgtcagtggtgcaacatcaaaggtcatgttctctctcagtgcaaaaccttccaacagcagcatcctagtgtcccaccgccacctcgtaactctccggctcacactggacaagtttaggtcaatactgcaactgccggcccatcgcaac

SEQ ID NO: 6167 - DNA, 1400 bp, Glycine max
  Soy_ogl_117 Gm01:37217501..37218900 Cluster 27
taagaaatcttgatacttgtcgtcatattcaattatttctttatgtttgactcttttttttcactaaagacaaatgacaagggatccacagacatgcatgccataattcgcaaaagttaatttcaaatacaaaattaatgtataaaggtattataaagaaatgatgcgtaatgagacctattgatagaaaatcacgtatatctaacgattcctccgttctagagtacctagataccaaataatgatttggtgataatgattgaagaagaaaaatacagaagcacaattatggagaccatatatggcagctatttcaaaacgttttctcagtaaaagtgactaaaattcaatgcttttgtttttcttttccactcaattattctctttcagtcacattaaaacaaggatcatagaaaaatatatagagtatgatataatatggatcatctctgtacaaaatacagatcaccaagaagaacagaagcaagctggatcaaatacattaaacaatatattattattgtcgttttttctttttccaaacaataaattatacaaattaaaagggtcccgttgctccctaatctccacaaagcttaagaattattgcctgcatcattatgttatatatttttatgctaaaaacacgtgcaacaaaccttctgtgcagcatgccaatttataaaagaataaagttaaagctatctacttcaagggaaaaaaattcaatttaactctgttttactaaattattttaaaaaatacaaattattgcggaaaagagttttttctaagccaacagaaaaaataaatatttaataaaaggagagaataaaactaatattattaataggtgcggtgtccaaatcctatattaattatttggttcgattacaaaaacttatatttgggtttcgaaatttagactaaaaataatactaataactattgcagtcaacctaaaagttttctatgtattcaaaatgctctatataatttgatgcatttcaatttgtcaatgactgtcatgaaatgcaatatcattattaactcgagaaatactgttaagatcaatatttgaaatagtgagttttgtttgagattgaaattggataaactaaatttgaataccctaaactttgaagatattgaactcagcaatttgcctggttccttatttgagtatttcctatacttctgagggtccttttggaattcaaagttccttcttcctctattattctttcttctgaacatcgttctttgaattgtctcaagatgagtgcaagctcatcatcttctctagaagttaagtcatcattgtcttctccatcatcataatctttttttttattagctaaagaaaatattatattacaagggataccccaacccttttg

SEQ ID NO: 6168 - DNA, 1951 bp, Glycine max
  Soy_ogl_135 Gm01:41052101..41054051 Cluster 27
atatagagtgtaagtacgctaagttattttagaggtacaaagaattctagataaggagtaaagtgttataaactatattttagactgaaacatttagatccatataccttgctgtaattgctgcatgtggcaaccatcatagggttaagtatgaaaacagagaaatcataggcaagtttctgtattgctttggtttgggagagagtaaatttcctacgttggttaccccgtagatttctgatgtgattcaacatatatagaatctatttggaagtctactacacaatagaccgggatatagaaaagacctacgataaaacagagatgatgtgtcttttttcttaaatggaaaagaccacaatgcagaacaattagaaatcctatgaaaataggaaagaaaaacacaacgaagaacatgcatcagttatcatatccagtgaaaattctgaacgtggtcaaaagctttgttctagaattataatgtccaactatttttaaagatgttaaatcaatgtagtccctaacatggaattaattaatatggtttagtaacccaaaaaatggagttaaagtataagttgtcatatggcagctttaaatatacaaaatgaacatgaaactttaaatatatcaaaatgcgttagtgagtttttaatttatcagtaccatattgtaaattaacattaataaataatactcagttgtaaatgaatattgataaatagaaaaaaatgatcccatagtcgttgtgtggcaatgtgttaagatatattcgtgcatgcattgagaaacaaagccaacatgcatgaaacaaaagaaaaacctcataagatagaccaacatgcacaaaatcaacatgatatgaaaacaacaccccaaaaaatccagattcaaccgaacatgcagaaaagcaaacacaaaatggaagaccataacagctggcaaactcaattggaagtgaaaatagaaaaaatgaagaaaaaaccaagcaaaccgaggaagcaagaacaaaaatgaaggaaagaaaacccctctaagtatgccacaagcaacccataaaattggcaatctagataataactttcatgacagaaccataaacaaaagtcgaaattggaaagagcaatgcataaattaggtaatgcaatttgggcacgaattttacaaaattccacatagcaacaaagtttttggttttacactgacctcgtttgaaccgattgatgagtctggactcatggtggaacgcgactgagtcttgctttttttggaaagtctggagaattggatgtttggaaagaaatggtgtttgcagaagaaatggtggagtcaggtagtggttggcgtagaggtgtgactggaggcatacaaataaatcgggaatcgtggagcattgaatgctggctctaaagattggacgtgtagaggcagttgaatcattgtggatgttcctctggtgaatgtgattaccaatatatatattttaaaaaatgcagggaagagaatgcattctttgtaaaaatgctgatgcttatatgaaaaatgtgttaaatcctagaattgataataattagatttgcatgacatctgacagggcaaatgaaatagtatgaatgaaactacttatagttatagttcatgcaataaaactgcgcttgttagaaaagttaaaacattaatttttggtgaataaatttaaagtgcatttaagaaaaatttagtactctttttacatctatattaaaattgaagtatcatatttttttatacattcgagtatagtttttgattttttttttagtttttagtttagaattcgaaaaaaatcgtggtatttttaaaaatggtatattacaatctatttagagtatttcatactatatttattattctagaaatgattaaatatttaatcaatcaaaagttttaaacaaaataagtgattgtttaa

SEQ ID NO: 6169 - DNA, 1460 bp, Glycine max
  Soy_ogl_1297 Gm04:35848370..35849829 Cluster 27
atatgtataatgtgtttttaagggtttttgtgcatcctctagcatgaacaattacttatataaaataaaagttacaatactcagattgtagttagaataatcacttccaaaaaagtcaatttttttagttaaattatgatttaaaactttcaaaacgaaaattcaaacaattctctcatcatcaacagaataaattcaaacgtttcttcattaaatggtaacatagaagaaggagaaaatcaaacatatataaaattaggaaatacataggagaaccggaagtgactcactcactgtgcagggtgcgcacgtattatagatttgagaatggcttgtggtccaatcaaagcacgatgagttgggtggggccgaagtggaagggatgccttcactccaaccggtttgagatagtgacacccactaaaatgagaggggtgctagtgcttccaagaagaaccatctaaaacaaaatcttttccaatcttcaggattatgaaagctgcaaaattttgaagaaaaaaaaacttcatatgtacaaggattcctctcaaatgtaacctgatttgcttccacttgggaacttaacttggtctgtgtccaaagcttccatatgcctagaatcatcacagatatggatagataagcaaacaaagctatccttgaaaattcttagagagagagagagacctaaggggagcccctcagcccccaccgtcccatgtgcatgtgaacatgttcccagccaaattacctgttcactcaacccatcataatcaacgggcaacactgtcactcggttttgtctgagtgcatgcctcagttttggcgctactagtattagtatctgtatttttttttttttaaaaaaaagttttagttaattggattctagaatttatcagacagatcccacgaaatctgcctaaaatgcatatagatttacgtgcatgttatttcccaacaaaaccttcacatctttaattatacttaaatcatatccttatcaattggattgaacaatatttgcttttgtctgtatttcctactgaagatcacttgatcccattgcccaaaaacttctttatatgaagagagtagatttccaattgttttagattattatattgttagtttgaagtatcaattaattttattgataactgatatttgattgaaaacttagtcgatcgaccatctttaacgagattttttttcatacataattaatagatttgcaatttaactttattttaagagccgctcattgatcactgctagcttatggctaattaatcaagcattgtgattgcgatttgtgaaggtgtgttcctcgcggcacaatgtcaaaattgtacaacccacaccacagtttcatatgtttcagccccaccaatatacgattctaacatttgcgtccagaaggagcgaaaggacaagcaatagtcaatagactgctctgc

SEQ ID NO: 6170 - DNA, 1812 bp, Glycine max
  Soy_ogl_1316 Gm04:39290001..39291812 Cluster 27
taaattatgaacatattgttagtatgataacagatatactacaaaatgaaagtatggtttgtctcatattgttattatgataacagatatactaaaaaatgaaagtatggtttgtctcatattactaagtatgagcatccatgtcaaatgattgagttaaagaaaaagggtgtctgaaattttaaaaccatgttagaaggtcccttctctctgttatcaaattaaaagtatcatttgtttcatattacaaagtatgagcatccctgtcaaataattgatttgaagagaaagggtgtctgaaagaggaagagtttgtattaacttatatatttgaaatgcatgttccttctttgttaagaggatacaatgctcatgttcgtctagaatttgatctcactgatagcagcctatttttcatactagccaatgattctaatgaattcaaccgatttgtcttcttcaaagtttcaatttattctttttgatttgatagtttaatgtgaaattattcactggcttatttaaatgattcgtttaggaggctagacaagttttggcacgaaaattgatgcttaacttagtggatgatttgcaacataacaaacgattggttttaaattccaattttgttgaagggttcaaacatatactatgtgactcaagtttggacaaggtatgcttcagttctttttttcaagattattcattttgttgatgatgggttttatcatatgatttcctttattgtactttatgtttttttttatcatctaggaatctgtggcaaaggcaataactctgcctggcgagggagaaataatggacatgatggggttgcagatccttatgttgttcatgttgtttgaactttcattaggaagcagcttgcaagtgaactgagatcagagttcctcagcaggcctattgtctgaagttgtctgagattattaaatatctttttcattgtatcaatctcctcaatgctcaccttttttgcagtggaaaataataggagcacagaagaatatgtcttcaatcactcaaacttctctaggcatgctctgaagaatgttgctcttggtatatacatatttgttgcatactaagattcattatgcatggtggtagcaagctcatatttttttaaataaaaaaaattatagcttatcttggatgccctcaggaacaagaattcaccaatcttgtgctacatgagtgtaaaactgctgcaaatatgactgagtagtttgctgctttcgctgccatagcccagaaccctggtaaaactcaagatgatgttcttactgacttttatggcaagtgacaatatgatttcttggtaaattttcatctctatgacttttttttttaaattattcttttgatgttgggcatgtctctatatccattcgttttcaatgtatcctatgttataaactttacgtcatatgttgatggtgagactggatttaattgatgatgccatttgataacaatttccagcatgcttccttttgatacctaccctagccttgcttaatcttttttgttttggcttggctggtggctattaaattctcgtgtttgtctcacctatatgtgcttattcgtttagtttaattttagaagttatttttacctatgactttatagttccttttcctttccaagtggcaaacaaatggtttgctccttaagcaatgtgtggcattcctgataatgttgagaatgtgcgaaaactattaagcaacccagcatttgatctactcaatttagtgctatgttaaattggttaagttgcttatctgtaac

SEQ ID NO: 6171 - DNA, 1172 bp, Glycine max
  Soy_ogl_1631 Gm05:29471243..29472414 Cluster 27
ttttctctcatattattcatcacatttatcgattatgttttcttttacttaattcaatttctttctttaactttattttttctttctctctgttcttccgactcatatatacttcctgaatttctttcctaaagttaaaatatgacacttataatcagataaagacatgattcctttaaagtaagaaaagtttacttagagaatttaagagaataaaatccaatgataattattaattaaaaaaatcgatcactgctattataatgaactataattttattatatataaattgattttatcacaattttcagttattgattttctaatcaacaattgtcagtgcatttaatattttaaaatacaactcgtcactttagaataaccaaattgataagataaaactcatgaaaatttgaataaaatacaactcgtcactttaatattgagtttcattctctactttttccactataagggatgatgaagctgcatttgtaggtggcatatcgagatcaaacctgacaagtgagctcgatggggtcctacatctctcactcactccccattggtgcaagttacagtaatgcacgtgagcgatgcaaatttgccacactccctctctattttattttacctcattcgagtaagtgagtaattagatggtgcatgatgttccacgttgacgttgacaagacagggcagtcaggccctaccaaagaatcgtacagaatactgattaccactctgcgtgttgaggacacacacatgacacaagggaggggtgaggggtgaccttgttattattattgttaaaattgtggtcctgttctttgttcacattttcccttcatctaattaagaacaagcaaaccaataacataactaataagtgtgcctagctagctacagcattattactactttcgttatcattagttgttgttggtcaatcaaaaccatgttatgttaggcttctcgagtggcccaattcattcagcttttccatccttttacccatgtggccatatacccaaggacaagccaatgccattaatagaaaagagaaattggaccagccaaagttttttcttcttttatcccagatgtctctaagctgaaaattaagaattatttttttctaaataataagattcattttagggacggtttc

SEQ ID NO: 6172 - DNA, 1776 bp, Glycine max
  Soy_ogl_2052 Gm06:41401001..41402776 Cluster 27
tgtgtgggtctgaaatttttcaattgtaaattttttatatgtatattaggtaaaaaaaaaaaacaaaattctaagcttgatttgaaccttacgttagaaattgtctttttcttttcattctcagtttgcgtcttgactgctgttggagatgtttcagcttcttaatcgacagcgagtactcttgtgtttttgggttgtttagcccatacaaaaaaaatttacgtaattacttgtatttagtattttatttgaaattacataattacgtaaaacattttactgagataataatatttttttcatcttaaagataaaatatttgagtatcatttatatttcttttgaggcttaattatcaatttcatctctaaaattttaaaatattcaatttgatattcaagatttttttttaaatatatcaatttgatatttttgtccggttaaactcatgccgttataattacaaatttcagcgatttttatttacaaacagtgagcgttaaatatttattactattttaaaaaataaaacgagtccaatttggatccattttcactttcccggaaaatcaatagtcagttcttgtagcctgattgggttacattatagcgtaggtagacatggcaaaatcaatagccagaagtagtattgaaaaagaaaaattccaatactaaacattccaatctagaccatatagataattaaatccttttttaatagtttttttttcatgatttataatgattgtatttacaatcaaatgactttattagtattttctatatattgctttaattataattgcagcaagcaattgttatcatctcagccaatgtgaagctggcaggggataccactagcaactgcatgtttccttccatggaggaattttctaagctgaaggaatttggcattatttgtcatcctagaaagtccactcaaataaagcaagtcacctagtatcccccaattaggggatggatcaagtgtaacactgacagagtggcaaaagattcttcagaaaccaccatgcagttattttgggctgctttgctttccatatagggataaaatatgttctctttgctgagttattggcagctaacaaggctattgagatttgcagggacaaagggtggcagaaaatgtggatagaatgtgattctatgttagtagtgcaagcttttaaaaatgagcacatagttcctttgggagattaggaataggtggaaaaatacagtttaacttgggatttcgtagtaagttgtatttactttgaagggaatacttgtgcaaatagattagtcttcataactcttccattgactctttttgttggtgggagtttatccccacctttgttacaaatctttttgtgaaggattaacaggtcttaccttactataggtttacatagtccctccaggtgttaggcttcatttcccccctctcattttgtgtaggttttttcatcttgatatatttaatgatatatatctggctgtgcaggctgcttgtggttgatgtctttttgtgctcgccttcttggtttaaaagaaaattaaaattaatttaataattaaagactatttattaacatttgttattaggacaaatttgactagaacattggatcacgtcaacaaatttgatttgttctaattaatgatgcctcttgctcgtatcagttagttttgctattgacattcacaaaatatttaagcatatatacttatttttttaatacattgtaaatattaaaaaatgtcatccac

SEQ ID NO: 6173 - DNA, 1179 bp, Glycine max
  Soy_ogl_2378 Gm07:34833901..34835079 Cluster 27
aaaatcatggaaggatgcattatatacttcctaataaataaaaatcaccttgaattttttaacactagttagcattttcttgagaaatataagaataccgcactaattatatatattttcctatatacgaaaccagactatcaaaatattgatgcgaggttactagagtgctatcgagtttgaatcctaattaattatttgtattaagtattaaataattgaataattttttttattcacataataaatctactcaactcaaatatgattacttataaatataacaccgaatctaagaaaatagaagtattttaagaaaataaaagtacctatagcatcaattaacaagaatcatcgaattaaaaataataaatgattgatattaaaatatttaaaatttcaaactaaaatttaatatatcataaaatcattcattattatcgatatcaccaggttgtaatcaaattttaaaaatttgatgcttatattaaattttaattttaatttttagatatttaaatcttaatcattatctattatttttaattataatatgatgtttattattaattgttttggtataaatgttatcacaaaagtcatattcagaaaataaaaaagaattagtcgtggcaaaatattcccacttaccaacctaattattaatcttgaaactgcaagttactagtagtgggttccacacgcatttacagcgaaatttcagctcccatgacaactataaacgatctgctaggcttaaaacattgtactgtacctctaaccttcaacacattcctcagttctttcgacccaacgcgcactcgcaaactacaaatcccacgccacacaaacaaaagtatctaatctccacaaccacactggtcaacacgtctcgcgcagttgagaactaactcctcaacatttggaattccagtattttctcactttgaccaaacatttatgtgctttcattgactttttaaatattttttaataatttaactaacgaagagttattaagagtactgattaaattttttttaaaatatgtcttttttaaaatattcatgattgtttttaaaagagtgtttctattagtataatttttatattaaaaagaccacttatattttgaattgatttccactatttgtatctcatattattaatataatataa

SEQ ID NO: 6174 - DNA, 1500 bp, Glycine max
  Soy_ogl_3103 Gm09:33592101..33593600 Cluster 27
gtgtccatttttgttttccaccaaggtggattgcatattctctaaggcaacataaccaaattttgcaattattagcattttgaccaaatcagcactttgttttatgatttgcatggatggacaaatcaagcctatccacactccttcaatccgtggcctgctcgtcatttatgctgactcagtgccaggtatgcattatttgttccgcattccccgacgaagcacacgagagccagagaactagtggatgtaattgcaggtccaaaaactcgatttaaaataaaatttgaaagggtaaaggaacttaattattaatctcctatcaacttcaactacgttaaatataatattaaaacttgtggcttaaatatttttacatttataaaagggttgtcaaatgagaacgttaagcaatttgccgggtttaattccagcaaaaaaaaaatgtctggtctaaattttatgggtaaaaaaagtgtttgaaaagacaactatattaaaagtgaggtcttatctatgttatttactataaacaattattaagtaattaaagtaaataatgttaatatattctgtgatttcttgagattccgatccacatattttctttttcttcttttttttaacgtttgtaatatgatgtaatacttttttaacaattaaagaagttagtgtaatatataaatgatatgattgtaatttttttaaaataattaaagagaattagtgttaagtaaaaaaagggaaatataggaaaattttttgacgaaattatatagaatgctggtataatttacttaaaattattttaacaaaaaagaagatgactttcacttttttttaaaggacttttttgttaaagaaacagtgaaaaatattttttctcatataattagtaaaagatactaaattacacgtaaatgtatagaagttaattaataatcttgtctctctctgtgtaacagcaagatgggaccaccaattaattcttttatttcaagatacaagtggatcatgcctatgcttttacgttcaaacaatcgatgtgatgccaataaaagagctttgcattgcattgacacctctatatatattatgtaaataaatatatgtcttaatttgtttgacgtacatgatagacgtaacaacgaacaacagtaatatgtttcttatgcctgaaaccgaaagtggataagatcgtacacgggccacaaccacaagtctagaatataggaacaatatttttttcgagaatattcggatgattaatataaaatgaagaagaaaaaaaaatatttttaatcttaaaaaaatatgatccctcataattctaaaaaaaaaatcaccatcgaattttgttcttcacttaagtcttaccattaaatgataatatgagagtaatgtgactttccacgcacacaccatgcacaaaggcaaacaataggtgacgatagtagtaagagagtgaggagacgatagtaggttctgatatcgtgggag

SEQ ID NO: 6175 - DNA, 1354 bp, Glycine max
  Soy_ogl_3896 Gm11:32922498..32923851 Cluster 27
atctattcatattgtataaattagaatctccaactttctaacttcgagagtgaaactcccactcttttaattagagattctcaacattttctctcttctctccttgagagatgcactacatacactacttttatctttatgttgtactttattttctgagccgagcatccatttctattttaaaataacattatatcataatttatttattttttaaaatctaaactataagttatatattaaaatattaattattataaattttaattataataactgatatgatatatttagaatatttatttttatataaattttaattatattaaaaaatatttgtcatgtgcaatacacacacgagttaaaatacaagttaagataatttgggcctttgaaatgtgttttggtgaatcttgaaagagttaattctttataactttattattaattattattaatcttttaaaaaagttcaagttttaaccaaattcaagtttgctaacctgttagccaagatagatgcaacacaggatttcgcgcgtttcatctctttgagacgtgtcctgctgatgtttgtttgttactgcaagctaatgtgcttggagtgacatctgctaggagtgttttgttgtttgcatttggtcctttatttcccattgataaaaaaaaattgctaacctgtcatgggaatgcttttaagttttaatacagcagataataaaaaagtaatatggtttttattgcttttctaatactatattgagtaaattaataaatttgataagataattgaaactttatttaacatactttttatttaatctgtattaataaaggtattttgcaatttactttttgcttcaatcgaatttgttcaagatttaaagtcttgcttgattaatttgaaacaatatttgtattttcattttcaatgtgtataattttggttctccatttaagttttgtgtaatatatatttttcatccatatactaacaagcactttgactaccaacaagtcgtttttcattcgttcgttctccacttggagattccatagttcctattaattaaaatttatggtcttatttcatacattcaaaggaggctggttttccttttctaatttgtgaaacagattctagaatagctttgctgatgatgactaaaggtgttgcaagccataatcctcatgtttcaatcattacatcaataaggtccttgatggaacaggattcaaggttactctttagcatagagaaggaaatactaatttaggattagactgagtgaggtctattgagaattttaagagaattttttattttaaataaaaaatttatatattaaacttt

SEQ ID NO: 6176 - DNA, 1347 bp, Glycine max
  Soy_ogl_4758 Gm14:40858755..40860101 Cluster 27
cctatcatcacctttttttccttctgtctcctgatttttatgtttgtgatattagagtatttttctaatcttaattatcaaaactgtatgtctgcgttgaagatctgggagagaagaaaacagttacagtttatagagaagaaggagaaagagtttttgagagagagggtgtgggcgttttggttatggtgtaggcgttttggtaagatttagaaagagagggagacagtgggagagggtgaagaaaacagttacagtttatatttattatttatttttcaaaaaggggggaaatcaatgacgctattaagtggtggccattgagcaagttcgaaaaaaaaaacaggagcgtttaaaaatcggtactatactactactactacagaggtttgtgatttggaattattttatattggcgaagaaaaaatatttttatttcaagagatttgtatggaattctaaatcagctcaggaattattttaaattaattaattgttttattccctgctcgcattagaaaataataataatgtcgtccattgatttattataattcttttgtatcatctttatcagttaattttctttattaatatcttatttatttaataacataattttggtgtgtgtatatatatatttgatttatgaaagaaatttttttactatgtgaacaaatttgagtaaccattcttattttagattttgagtaatcatttttatctctaaaatttagttatatatatatatatgttttattacaatactgcttgacttaatttaaacaaatatatcagacaaacacggagtagattaatagtttgagaattttagaaaataaagagattgaaaagaaaatattgaagagagaacaaagaagttatgaaacggagaaaaatttacgttatatatatattacacatgcacttctttatgttagtttactgaacttctttttaggcattagtatgtcttattttaatacatgattcaagttcaattttttaattgtaaaaatacaagatttagattattttattttgcgtttttcttttgataccatctctttcaagttcaacgggatatagctattcaactttgtcttttagcaaacatctgatttaggttttgaaaaaaaaaagagtaaatggtcttgcataattagttttgaaaggcttttgatacttttttttcctcaaaattttgttgatatttatttattaacaattctattgacaaagataaagtttaatgggtaattttgctaataatgtgggagcaagtattgcagttacatgttcatgttggtagaaattgtttaaaaaccaaaattatggatatgtttg

SEQ ID NO: 6177 - DNA, 1119 bp, Glycine max
  Soy_ogl_5123 Gm15:43843482..43844600 Cluster 27
gtgtttggttgaatgtatgtaaaagtatttataatgaaaatatatgaaaattaaactctatagtttctttaaaatttatgtcaatttaaactgcatttgaactctctttttagatataagaaaatcattgtgtagttttttttttcaaatagaaattaagtttatcagtgctcaagcataaaaaaatatttagaaaaaagaaaatataaagtttgaaaattcaacagcataaaatcctagtagtctacaacttatacgattatatgattgtttccatggagaagattgctatttttttgtcacaaatacgataattgatgattatgttataaaacgtcattgaacacaactttcatccctcacaatcatgcaggatttctttctttgaccagacatctttttgtaaggtttgtgtcaacctctatgaccaacctagtgagttttgtctagtgtttttcatcacatctaagtatctaacttccaagagagttagtattttgaattctttttttattgtttccaatccataaacaatagtgtgaagatatgtttaaccataatttatgtttgtatacattatataaaagaagtctctaagtcaaaatgcatcatctctgtttacactggaaaaaaaaaattacactcatatatgtgcttgaagtttaaaaaaattacttaattcctcttttttcaaccaataataactgtaaattaaaaagtaagtttttaatatattttctttaaagctcacaaaagcaccctatggccaagagacaaaattttagaagggaagaaaacagaattagatataatatataaaatacataaataattgaaaaataaatatatgccaatgtattatttcattttaaaaaattaataaattacaagatatttcttaaaaataaaaaaaaataaaaatttcatttgtagaactccactttcaaacttaccttaaacttttttataaaatattttaaactaagtaagaagagaataaatggctaactaataattaaaccatggcatggtgggattggtgggtgaacttattctatgaaacagtgcgagtttaaaactcacaaaaatgtacgtaactaggagaggaaaatgtttgag

SEQ ID NO: 6178 - DNA, 1194 bp, Glycine max
  Soy_ogl_5352 Gm16:26819807..26821000 Cluster 27
gatttacatgcttaaatcatatattttttatacttaaataaactaaaggcgttatatctagagtgtaaagatatttacaagagttgaatagatttcttaattttatttatgcgcattaactatgtaatattataatttaaacggtaagaataaggatgatactatggggagatgtattttcactaattcgttcaaacaaatttaggcgttttctgtgatcctttctcaatactaattatgtttaaatataaaatagttttcctttttaaaagggttttctcttttcttttctttttgataaaaaagggctttcttttaggcaaaaagaaaagcatgtaaaagtctttttttaacaaacaaattttgagagaaaagggagtgttcctattattacaactatatcttttaacatgtacaagaattaaacacaataactttttagcatgctattgaatagtgccaattgtgagactcaatgaaaaaaaaaagaggcatgtcaggtgattgtgttgtgtcctctctcaccttggtcatgactcgtgttccacaaatatttggagctgattgagaggtctgtggtgtagaatttatgccgtggctcaattcggcaactgcactgtcgttttcatccttcattcatgcatcacaagaaaaaacaaacgagaaaaaagaagcttgcaaccacaagcaaggactgggtaaaacaacttcaccgatcataatcaacacccctaattgttacgttaagtacgtattgccacttgcttaataaactgaaatgacccattcaaaattcaaaaaagaaatctgcataattaatagatcattaggttttttaaacatattattaagaattctttttggtagagttaaaaatttagaaaaaggaaatgatattccagtccaaggtaagaaaaatatctggaaacaaagaggacataaaaagatatttatatttatctcattcaaaagagacaaacgaaaatttaaacatataacttattagatgaaaaatcttatcttatttcactctgtcaactccttagaattatagttttaataatttgacacaactttttgaaaaaaaaaattattagaagacacaaaactcagtttaaccatatttatgtttgaaaataaattagtcttaaattattagttgaaaaatattctttatgacaagaaagaaaaaaa

SEQ ID NO: 6179 - DNA, 1248 bp, Glycine max
  Soy_ogl_6030 Gm18:12370101..12371348 Cluster 27
aaaaaagtgtttaaaattattaaaatattatcttaattagttcttaattaaaatcaacaaagaatagtcatttcagtccaaaaatatttatcatattattctttaaagttacatatataatataataaatttcaacatattaagttgcaaagaatcattttttggttccctggatcatcttagaccatcaaaatgagatgcaaagaaacacgtgaaatacactaatatacaaaacatgaagagagacatagagagtagtgaggcagaaacataacacacaagactgcaatggcagtcaaaggcactattgatgagtgaacaaaacaaagaggaaagaagtctaataaaatgacaccaggattctaacatttgttggtgccaacactctacacgataaaagcttccaatctcttaccatttttaatccttgtttttctctttcccttcttaatcctttaccaatttctacatacctcacctaaccaaatccaggcctagcttacctaattgagcagctttttctagaaccactccattaactctcttttcattacactccaaacccccaactagtctcctttttttgtctttcttgtcattcacacacaagtctttataagcaatcacaacattgagtaggtaacaaactcaccttagaacaagtaaataataaaacactgctataagtgtggaacatggcaagtagtgattaattgtataagtgggaattgtccataataagttacggaaaaaaaagcacaaggcataaacaaatttctattaagttgacaaagggggaagggggataatccactaaaatagaaagatttcctagcaatataaacttatttgcttgtaattaagtgatcttcacctgccatcttgaagctttagaaaatatgccttgtcttatgacacaacaatagcagatacaaaagctgcaacaaaagtccaaatgcaaggtacaaaatccattagaaaacacactagagtaaaaaagtagagagtagaacaaattcggtaaaaatacaagtgaaatgtgttggagacttagaagtcccaaaattaaaataaaataactataaaattataacttcaagtatccaattattttgtgttatatctcttagctagggccgaattttttttttataaaatgggttatcaatatcatgacttacatcatataatagttcttttttctctaaagcttataaattttgttaagtgggggtgtattcaatcctg

SEQ ID NO: 6180 - DNA, 2619 bp, Glycine max
  Soy_ogl_6032 Gm18:12534275..12536893 Cluster 27
gagtttagtcaatagtgtacaaattgtctacactatccatgtattaattttttacttcttttataaaaatatcattttactgtaaccttataagctgccttgaataatattgtaacatgcatttttattctcaatgcattcatcataatcccacatctttttcccaataaatttcactcctcctagattcatttttatcatttcaaacaatgtaatccaaaaagcttaaaccctttaaccaaccaaacttagaatcatcaatttccgaaagattatcacaccacatgtgaaggtagaacaaacagagtaagtgaacaatagactccaaacttcaaaaaaacttaatttcaaagagccgaagaaaggtaggtgaaatgaaaattaaagctcaagatacaaagcgagattaggtatagacgtacatctcctgctgattattatactgcagtggccaatggccatcatgacttcaatatgcaaacaattataatggtggtaagtgtgcatatagtaaaggtgtattcggataaacaatttaattatgtgcttatttaatcatctcttgttacacgagatattttgtcataaatttgacaagttacaccaagaaacttgttgtaataagctaaaaagaactcgtaggagtcagtgttaaaagtcattttcataagtccaaataagctacctaaaaacttccaaatgctccctaagattaggattaaagaaaatatcacttattcatcccaccatttgagtttcaaaagttgccttagataccagatatcaagcatgatctgaattcacttcaaatttcctaatgatacttaatatagatagatatataagcaggcacagttgaaatgtttagaacaacagtgttctccatttcaatcaaatacaccaaagatccaggatgttcgataagaattataaggcaacatgataagaatatcgtcaccttttggtcttgtttgccgccagaatgccaggcctattggtcttgtttgccgccaaaataagaatatcgtcacctttaggccctggtgctggagccatttgtgtgaattcactcttccatgaacccaaattctcctcttcttctcttgcaaaatggaaacagtgcaaaaaaaaaagtactaattaaccacatttgcaagcaaagcaaaacaacccaaatgaaaccaaacccacccacaacccagtatgcaaacacaaggcatcccaaatttccatttctacaatcttcacaataaaaaattggggaacccaacaagatgaaatgaagaaaaagctatgacacacaagttcatttcaccctactaaacaatgcactgattaaattccagttaattctaccacaaacgaattacaaatagatcaatattcaatcatgagttttacttttgacaacactaggtatattggataaaatctgcaacaatgaactttagcgaaatccagccaccgagtgcttccccacacactgcagtgagccacggcggcctttggcggattgctcaacctcatatttgcctttgatcttctccttttgccatgctgcaccccttcaccatctttctccttctccttctcaccattctgaacctctaccacctcacctttgctccctaacactccatcaaccttcctcttactctcaccactcaaatccctctcctccttcacataagagattatccccttcgacacttccctgctaatcacacaccccattccttaagtctaagctccatccatccatattgtatcggattcctaattacctaaacaaccattaacacgttaatcaatccaataaaaaaacgataataagataaaagcacctaagcttcactatacgacagagaacgatttcaattcgaaattaaatctaaaatcaaaatcagaagcaaacttggtgatgttcatgattttcgagcacggcgagattcagtgagctatattatactaagaaggttccttttttttctcaatctttgcctcaattatttgattctaagttctatattatacttgcaagaggttcaacacaacaggggataatggttcatggttgatgcatcctcaattactcacctttataaataaacactacctagtgcaagttaatcaacctttgtcgcaagacaaaggaacccacggttctagaaacccatagcaaaatggatgcacaatactccttccctaagtgcgaagtagcagattgcaaaatcttagccaccaaaggcaacgcctcagctcgtaagtgcataagccctttccacactctccgccaatgccaccagaatgaccaaggaatcagttacaagattagcattacccaaagaagctaacgtattaacaagaacatgaactgcacccgccgataacacaatcgcgtggtttttccgacgcaagagaagtccaaagattgcaaccacggaattgtttcttccaaaagttgtttcttctttcaccatttccaccaacaccagaatcacatcagggtcaactgagtggaagtatgaaagagtatgagagtgagagtatgagagcgtgagagtgagagggttagctaagtggaggccagcagggaggaaggttcaagaactagggttc

SEQ ID NO: 6181 - DNA, 1219 bp, Glycine max
  Soy_ogl_6710 Gm20:24422382..24423600 Cluster 27
cttttttcaaacattaattattctttggtaagaagtaactaagtggagagaaaaatgatcatgggttgtgcaatccttttactgatttaataaaattctttttgagattattttaaaattcaaaagcttaccggaaaattcttggttttaataatgtgacatatttcaataaggtccaattacgggatttccggccttaatgctttttttttttttatcaattatggggtttacgtttttgttattattatcgtttaaaaaacatatcaattatgttttattacggtcttaatatgcaattcttttatttagttatccaatggctacatgctacctaacgctctatataaaaagttctcctcacgctgttttagacacatcgacaaaaatcctctcttctcctcctttgtattcttctatattcctggattcaagttttaatccttaccagttttgtagcgtcaatgtatctgaggagtttctgtcatatcctgaaagatatcctgaaagacttgcatgagataccataaataagtaatataagtcagtagtcatatatgcccctgaaccgtgatctttagcatcgtttccaataatattaaagtcatgttaaagcaaaactttattgcacagtcatgttaatatcaaatgtcaaattaataaatcgatcaaaattatacaattaaaatagcagaaacaaatttatgaaaaatatgaggaaattaaattcaagaaatgaaatagtaaagggactaaaatataatttcacttattttattcatacactttttgttcccgtacactaatttgaagtaaaaaaaatatatggattatatattattgttggttgagattaaaaatggttataaaatgactggatgtaataacatacaacagggggatgattcaatacagccaaaaggagaatcctcgaaagccctatcctggttagggcatgactggatgtgttcacagttgtatataggtggactccaatgaagttaaataaggaggacgtggaaagttaagcttaaacagtaatcaatagaatatccaaacattttaagaatgatctgaaaatttcattttcgatatgacacaatcccatgagcaaagcaagcataaaatttctctgcgggcaaaatgaatatttgaaactgaaactttatgttttaaaattaaaaataaagccagtaaaaattggtctggttagtaaaaa

SEQ ID NO: 6182 - DNA, 1200 bp, Glycine max
  Soy_ogl_172 Gm01:45729101..45730300 Cluster 27
aaattataaatacatttgaattaattttaacaccgaaaaaactttagcaaccaatttttttaaaaaaaatatttagctattcatttactcaataaaaatttcattatcttaagtaccaaacataaattaaattaaacatccgtgcattacacgcatagtctaactagttaaataaggaaaacgaattggtgtatattatatcacgtttatcttaattattttattgtctataacaaagtaaatataacaaaactatattgccaatacattacttatatcagtgggattttagtagtttatatacccaaatatgctgattctttcgaataaattttcgtgaaaaaccacacgtacgtcatttcagccaaatcttgtcttatttttttaaatttaaaacttcttaattaatacttttttttataaaaaaaaatgtcatgattccatgtaactgttcatgcattttcggcgcttactccttcctaaatggtgtgctacatctctgtcacatgggtattttactggaaacagtaacagggatgcatgcagaaaatggtttgctttcacacggcttgtgtgaatcgaactctgtcataagtgatttgaaggaacataattataggacaaagcaagagcttgatatgtgcagaatcttcaaagggaaactgctggctgacatcaagaacagttttgatcgtattaataagaaagaagttgaagctggagaaatcaccatcaagctaaataattttgctaaaaacatatcagacctacaacttcaggaggagatgatgctgcaaaggtcaaatgaaatgggatcccaacttgctaaactgatgagggaattggatgtgagtaatacagatattgtgacatcccttttagatcaagagaaactactgaaaaagaaagtagtggccattgaatgtgaggccgaattttttatggtagattggtatgccaaagactttgaatcagttaccatttgattcatgtagccaatctcatttaatttagtggaaaaaggcttaggtttctgttgttatttataatctttgatgccatgagccactctttgtctttcttggtggcataatagttgaaattctttttaccttaaccattatcactatttttaaataaggagtaaatctgtaaatggctattaatttattatttttaatttgaaaacataagcttact

SEQ ID NO: 6183 - DNA, 1783 bp, Glycine max
  Soy_ogl_838 Gm03:4444141..4445923 Cluster 27
ggctttactaataacaaaataagcatcgagaaattgaattaccaattacacgatattatgttattacagtcatcatgttaaccaaactgtgaccactaattaagctttcttataaatcaaattaatccattaacccaaatacctcatacaaaaaatttacccacttaaggcccagctattacatgcacgtcataaacaccactaaagtccaataatgtaaaacgtctgaaaccattcacaaaaacctctttgcttacttccacaactatccaccttcagactcctcagatcaccactaattttcgcattccaaaagcaacaattgagttgcaccgttcccaacaaatatctaccaccacttataccatcgggaagatggatcaattaataaactccaccaaactactaaaccatcttacacgttcccctgcaaacttcatctcaacatcttatcaccatactttcgcttcagaataacaccaaaatgagtatgacatcctccactacctcgaccagagtaagcgccctttctttaaaagttcatctcttctaacccatgttttcttctcttacattcaaccacaatatttaaacttctacatttctgaaccctgccttcatacagatgaaatacccgatcataaggccaccctcaatcatgcaattcaaggcagctttccacaatgaccaggttatactttaaaataccaaaatttacatttttccccttactattatcatacaatatatgaccactcagtcttccaaaatttacgtccaggcttttatagaaataccgtcattctaccatcaacaatgggcaccaaattacccagaatccgttcagttgagatacaatggagcaacctaccaaatacaactccaacagcaccgaggcagattttttttagcagatggactcacagacttcagaacagatttagagatctacgagtccatcatcatcaacttctttgcctatgatcataactccatctttgatgtacacttcactccttcactcgaccaacagacatgtgccagaccactacttcattctcgtcaacacatctgaacaaaagaaataagtcaatgtatcctaggtgctccacatccactggtaacttgcaattacatcaatttggattattatgacaatttcaatcccattattaatttttataaataatatgcagaaaatctcatcccatgcagaaaaacatctcaatgaatgtggtaatcacatgacaattttaagaaagcatggacctcctctacaatggaacgtggttaccctcgatgccgacattaatgataaaagcattatctgaccatggtataagttcctcaacaaaaatgactttcatcatggagatgaagtatcattctattaccaaccgcatgaaaaaatttgggagatcgtcattagaaaacaaaggaagtgggaataaaacattatgtaacttttcttttacatgttattaacttttgcttaaatattttgttaatacttttctctgaacaatcgctctctgatcaatattatggatatatatctatttaatcttcaattctgtctaaattattgtaattgaactaaccaagtaacccatgcgtacgcacgggtcagactagttttcatgaaatttcatccttcaaatcttatctatacaaaaatgttattgttagttaagtaaaaaaaaaaagtaagattatctcaaacaacaatagtaaaataagagagaaagaaaatttaagtcaagaaagaaatgatgagcaaatg

SEQ ID NO: 6184 - DNA, 1300 bp, Glycine max
  Soy_ogl_2026 Gm06:21193201..21194500 Cluster 27
taaatatataatacattaatagtttggggagacatgttagtggttattgattaagcaacttgcaaattgattctttacaccatcaatttcctcagtggagaaaggatttggattctcaatatttttccaatttcagagcataaacccattaactagatcaatccaaatcaaactgaagagaaaattctcaattagtttgaatcatcgattcgatttgtattttgaaagtataaacctgataaatttgtttcaaagatcaaatttgaacatgtagaactcaaactaacttaaatccatattatttaaaaaatttatgttgtttaattctataattctatgaatttaatgttttataattttttatgaactaatgttagttagtttttttattaataagaaaattttgaactcacgacttcttttttctccttctttctttcaccactaaattaattttataactccttttaatgttttgtaatatatttttggatcgagtgtcttaaagacattaattaaagaatctcaataaatataatttttttttattaagaattacgttgggattatattcaaaatcaagaggaagtacactgttacatttcttaataaaaaaaaacttttcattttgtatttcttaacaagtaccttttaattagaacactaactagctttttcctatagttttaactcagttccttctacgtttgaagtttgcacattaaaaaggtcctgtactgaagttacatctctttctcgttagaaaaatgttggtggaaaggattaaccctgtagagtattgaatcctatagaaactctgataatttgaaaaatcaaccttacaacgaaaagtttaatctaacctgacctggatttccaaatatcttgccaaaatttaacaaaaagagcaaaaatccgtttgcattgtaaaggggaatcttcttggcttcatacccacttcactaaagatagtagcagaagaagattctccgttgttagcatcctttatcgctcttttagcgaggtgattttttatttctgccctctttaagcttcgtgagttgtgttcccttaatttacagtcaccgaattggaactaagatattcgttgcttgtgcgcaaatattttattctatatggtgaatgtctcattttttagaattagatattcctctttttaattttctctcttgatgcaatcaaatccggacaattatgcaacttttggactcggagaaagttgcaaggtggattgatactaaacctattttgaatatgtgctttctttttccctttctct

SEQ ID NO: 6185 - DNA, 1200 bp, Glycine max
  Soy_ogl_2056 Gm06:42645901..42647100 Cluster 27
tagcacacatcaataatgtggctataatctgtctaatcatgttgatgactttaaaagaagccagattacaagcgcaaaacaagtgtaaaaacagagggtacccaatgcctaaagccaaaatagtagatgggtcatggggaggtaggtgactgcaaaacagaggagtcacgtgaataaaagcaaaacactataaagaaggctagttcactacttggctgcactacattgaaaacctgacaaaacccctgaaaaatctaattatgcactgcaaagtgagctttaattggggttaatttaggaaatttcaagtatcaccctcatattttaattggggttaatttaggatatttgaactgtggaaaaagtttttctttaccaagtacagaagaaaaatatgaatggggaataaaaggagaacgtcaaaattataaattaaaaccactcttgcttttccttcatgccttaaatattttttactataatacgtttcttttgtgtttgtgggtcaaaagttttttcctttttcctttattttataattgaatttgttctctttgtctttatcagttgtaaggaagatcgtgttagaaatataaataacgatttataaatttcatagagcttacttttaagatagtttttttaggtaagtccttctttttactgcaaaatcaattttaggcaactcttaagatagttaaagcttgacaaacgtgagttttagaaatataaagagggatttataaattttcatagagcttagttttaagatagtttttttaggtaagtccttcttttgactgcaaaatcaattttaggcaagtcttaagatagttaaagcttgacaaacgtgagttttagaaatataaatagggatttataaattttcacagagcttagttttaagatagtttttttaggtaagtcctctttttttactgcaaaatcaattttaggcaagtcttaagatagttaaagcttgacaaacgtgagtttttaaattagcaatcgggactttgatcatcctcaaattattttttcactatatttacatttgcacacgcaaaaaatgagagaatttattctttctctaatttcaacctaatctttttttttatttccacaagaagtttgctaaagataaggagaatgtaaaatgctgttttttctcttttttttaatattctttattattttgaa

SEQ ID NO: 6186 - DNA, 1400 bp, Glycine max
  Soy_ogl_2334 Gm07:14541701..14543100 Cluster 27
aatattgggatacaaccctaatatttccagcacgacttctcttggctgtagcggttatagccatcgtttcctccgtagggtgggggacagaatgagacttcaaacgtcattctcatccccaatttattaagtaaactaacattagccatcaagtgaaatcaaatcaaacaactaagaaacccgaaaaaggaagatccgcatgatgttttgaaagacctagctagatgtactacttccaatgccaatatgcaaaaccacttcagaaaaaaaaaatcacaatgataaaattaaaaggatcgaaaagacacaaatatcatgaatgctcaacaagaaatttgtggagaaggaagaaccgaagatataatagcattacgtcatgaagagactttaattatacagaaatgttatattcacttgaataatctcctcaagaattaatttgaacgtggatattatggaatattcttaatgtatatataaatcacacacatagttatatccactttgatttgttaagagtctagggggactagaaagaactcaaggtgtagaagagatggatttccatagtttagatctacatccacacctgcatttcccttgtgcaccataataaagaagttattcgaacaagaaattatagatgaacgacattgacgacgtaaaaattgttattacagtctaaacataggctaaagcaaacattattcaaaaagcacaaggccggctttagattatgcgtaattttgattttttttttttagtcgattaaattcctctggttttaaagcttagcaaattttcaattaaaaaacctaattttgattcttctatctaaaactctcatgttatatttatttttataatcaaagaaaaaataaaggtctaattgtttccatataagttataatttctttaagctacttgtagcctacttaaataattttttaagcatatatcatatgttatttttcataaattcttccaaatacttaaacaaatttttatgtcataagataaatctaaatataatgcagtcaaaaaaaatctaaaggggtggtctaagggactccaatttaaaaatggagttaaataataccattaagtgactctatagaattagaaaggttatattataagttgaaatcacttactaattttttttatatacaaatctttgactaattatatattttcatattaattgtactaattacgtatttccccaataaaacaaaaggctctgttgccaccagtaaaacaaaacagcgactccaccaatactgccgtcacagagggatgttgttagcaaacttcttaattattataaccccattgctccatcaatgaatcttgaaaaaattaatcagtcaaatgaaggtaaattttgagtcggaacg

SEQ ID NO: 6187 - DNA, 1526 bp, Glycine max
  Soy_ogl_2769 Gm08:19388736..19390261 Cluster 27
tatgaatgttgtgtaagacaacattcaaagacggtcgctagaaaataaccgtctttaaattctttgtctgcttcaacattcaaagacgattgttatgtaataaccgactttgaatgcagtgtcttcaatgatataattgcgatttttagataattcggtatctgaattccccacggaatcactccatgacttggcaaacaataaaataaatgacacctaactaacactattaaaaccatggcacaaaattgaagtcaattttgggggaaattgatttaatatgttcttgaatgatataatttaattttgatgtcaactaaagaataaaaaatcataagtcatccaaactaaataaataatttagatcatcaatgattaataaacttaggaaagaatcccaaacaaatacatgaaacaatgcttacaattagtcataacgaccaaacaacaatgttttcaaatgaaaaacaaggtgataaatagcattcaaagcagagccgttgttgggagcaattagtttatcgtgcactgcagaacaataattaattaaacaccaactcaatcattggaaaccaagaatcatgagtgttaaacatgcaaaccaaaaaccaacacgatcaaatggtgaacaaatctccataagcacttatgcgagaaataaataagaagaaaaaccgagtttatgcacaagttaaaaatcagcttctggagaaactaaaatgagaaaagttttacaaattcacttatgcatattcttcttatgataacacatgatcatatgattcataccccaaaagagcaagaaaggaaacaaaaaaaagtatatattaagtcgtaaaattataatttaggaaaacgtacaataatggcatttagaattatgtaagttactagtcaaattcaaatcttataaaatgtaaccaaacataactgaagaaaatacaagattgaaaatgtcttccgccctcagagactgcttttaattttttatcgaaaagaagttttttttaggacaaagtatcttttttatactgtctttaaattatactagatccggataagagaaacttaattgaatatttctaaggagatatgatttgtcaagttattggtattcaatataatcatgtgcattcatattcctaataaatgtagcaaagaccaagaaacatgccaaaactctgcatcctcaccacaacagccaataggacagcaacaaaagtaaaatacctcccacagctgactcttagtcatgttgaagtgaagattccccacatacaattttcggtccacagctccataggggccagttacaccggctgctccaccaaaagcattagattgaacaaggttcttttcagcttcagaaggtttcaccattaaggaaataacaggaaaaatatatttgttcaatacttaaggaaacaagtttaaaaaggcttatcagctaaaatatatgttcaagagttaagatggagactttacatttcaaaaattactaaagagctgctaaatgagagaatttt

SEQ ID NO: 6188 - DNA, 1352 bp, Glycine max
  Soy_ogl_2779 Gm08:21436359..21437710 Cluster 27
aaatcttccctcccccaccttacgccacaaagaaacccaacccctctccccttttgttgcaaccaaacccttgtttgctccttaacctattgaaaagagaagaattaaattttttgacattttttagtcgtcgaaatctttatctaattaataacatcatctttgaatggaagaaatgacattttataattagtttagaaagataaatgactaaaataaattttttaagataaatgaccaaaaataaaataaataagcaaaaatatcatttagagtatttgaaagacttgcataaactttgtcattcctagttaggtaaaatagaaagacaaggaaacctcttggaattaaaaatgttcaaggttaaattggattaaatttggaaaaaaaataaaatacaagtcaaccatttttattggtctagattgatttaatttttttataatccgaatcaaatcaactcaactaataataagttggttcaattttgattaaaatagagtttttctcaagaaattatatatgagaggatacatcttaatgagaatgagaaattaaattcggatcgaataattaaatatgaacggtcaaaatttaatattaaaaaatcatatgatatttttttaaaaaaatcacataattttttaagtgatcaagtgatattaaattttaaccgttcaaatttgattatatgatttagatttatatataattttttccttaaaaggtataaacaacacattttattgtaattagcttacattaattaaataatagtaaaaataaaaaaaggttaaaataaactttttttctcccattttaaatatgacacttatgtgaaaagggagttaaatattgttaaaaaaacaaaaataaatatcttattggaaattgaacacaagaactctagcataaagattaaaaaatgatccagtaagataattgcttggcaagaattacttcaatagctattttacaatcataaatgctctcctcccattacataacaattgtttatcgctctccaacaataaacaagcaattatcaacaacaattaaatgcttccacatccaacaatcgataagcaaatcaacaaaaataaagcatacaatcctgaaccacaacaaatagtggtttaatcactcagatccggcataaagggtccaaaattcaaagggataattttgcaaaacacaacaatctcaatgccaaaatccaaaatgaagattaaaaccgagaaaacacagagggaagggaagggtgtgtacctcaaataaagcaccgacaaaggtagcacaagcaaagagtgacagtggtgcgacataaagaacctgtacaaaaatgcaatgta

SEQ ID NO: 6189 - DNA, 1417 bp, Glycine max
  Soy_ogl_4059 Gm12:17619838..17621254 Cluster 27
aagagagcaagaatagcaccttccacaagttaatttatgtcaaaattgtcatggagaggtttacaattttgttgggatcagggtcaatggaaggtggttgttgcatcacagaatgtgatttccatggacaacatcgttaatcttcatgagcattgtgggattttttgacgaattcataatttactctggcgacaacaaattgtaatttactcctaggtttctttaaagccaatacaacaactgatattttggttggttggggtgtgaaacctgcttcttcatgttttttctttcccctccttatgcactagctcttaccatcctgatgtagctcatatattacaacaatatatattacaacaacacatcatgactatcttcatgtttaatctgttgtggtctcctttttgtctttaatttcctataactattgaaattgagtcatgaattacaacaaaagacaacgatgaatgctaaactgaagataaaatttgaaattcaataaataaatcacacgtaaatgaatatggatgaagaacaggagtgaaaataatgaattgtgtcatgactctagttttccgttgttcgaaatcaaagataacatttagagtttaaaatggaggaaaatgaaaatttagagaaaagatgttaaaggaatttcaatactttctgaatacaaaaacaaaagagaatgtaagggtggggcattacaccaaacatgtggaaagcatcaaagaaggacccaattttgcatagaaattttggtatgcccatcttgtaaatcatgtagaagaggcaaccacccttatgacagatgcttcacctacttcaacaacttctcttttcaggcatgaaaatgaaatggtagaaggaaatacaaacaaatagacatgtgatatatacagagtgatgcacaaaagtagaatgtaacaatataattattattacaaagaaatgtcatgtaaaaaatataattattattacaaagaaataataaaatgtaatagttaataatgtaatgtcatgggttttggaggagtactccatggatgcataggaatagaaatgtcatgtatggaaattgctatatcagactgcacaaggacacattgttgctagagtagatgaacattcttgatgaattgtgtgtgaacaattatttggatagtgtaattgaccaaaaacatggtgtaacaacaccaaacattgattgtggtagtaacggttacagggtattgttagcctgagcaatgagatgggtgagtgaagtaacgacaaatcaacaaatggtctgatgtgacaacgtactaatttgtggagatatatatattataaatagatatcattatacatttagaatataaaggataatatacattaattaaatatcattaatttaaaaaaacgcgtatgtaac

SEQ ID NO: 6190 - DNA, 1300 bp, Glycine max
  Soy_ogl_5680 Gm17:13950201..13951500 Cluster 27
aatttagaattgtaggaatttgcgtcttcttatataactcaggagctatgtgtctaatatttccctattgtaggccatgtattagcagtcaataaaacacaagagagcaaggccatccccattttctgcatgatttttatcttgatgggctccatcgaagaaaatacacatgcattaatgcggaaaaagagggtaaagttttctgacatcttttgaattcagatatgatcgcaaaaaatggacttgccattttaaacacaagtcgcttcctttcacaaattaattcatgtttcattgtgtatatacgctgattcaaattgtaaacatagaaaaacgattaagataagtaataaaaatttatctttcttaatcagataatttaagattcaatatcttcattagttattgaatataaaataaattatattaaaaaaaatattcaaattatatatgttcattattttcaataaaaaaaatgaacaagtggagaaaaaacagtagaaaattcataagtcatagtttctgtttaattaaggtgtaagataatgcgcgaaaatttctcaaccaatcatttttaaggttctgtgagggacatatgaagttttattggtcaacgaaatttgagtgatatttatggatatgtttggctctcatggtcggtggtgaaaacatagagctagtgattcaatatttacttataggcaagtgattgatgggttccatcaaattggatccccaaacatgtctggctggcttcacattgatgaagcataatagtcaaagcttgggctgttgggcagccaagtagggaaatcatcagaattccataatcattatggatgtgttgaaacttaaagtctttaaccaatgagtttataattgaagtacataaattaaattgattcgatccattccaaactaggtaatgttgtttggatgaggtcccttccttttaatataatatattaatgatataaaataagaattgtgtaatatttataattttataacatcaaaattaaatattatttaaaaatatcaccactcatgttatataacatatataaaacatgcatacaaaatcctgatttaattggcaaaatgcataatacctttttaaaaaaataaacaaaaaataggcattgtctaatttgacagaaaacacgcacttcaaatgatgaacgcattggtgagtgaaattactttttgcagtccacgtggattatgaagtatttgctgactgacaagcttttgaccttagtttgagttggaatgaagaggaacatgccaattctttgtc

SEQ ID NO: 6191 - DNA, 1346 bp, Glycine max
  Soy_ogl_6714 Gm20:30951601..30952946 Cluster 27
gcctgcctttcttttgctctggctgaacatttctccctcctcgtgtgcttattacttaatgtagcttttgctttgatttctttccactgagtcaggttctctacagggctcattacagaatgcatgcacatgcttctgttttgtccacttcttttgtctgccaccaaggaatgcagctcaagcaagcaactctgtgtcttgtgttctgattacatgcttcaaacactttattgtctttttcactgcaatcattatcactatcatcaaatacatcttcgtcgtcgaatgcttcaatatctgattcctcatgctattccataattggttaaggatttaaaagtgttagatattggttaaggattaaaaagtcttgtatttttttttcttaaaagtattactaacatgccgtgatttttaataggataaaatgtgttttattaggtttcttaaatttgggttaaaattggtcttcactcttcagtctttatgctttaaaaatgataatttagtccacgtatgttacataattggtaaaatttgtctctcatttatcataagtttcattttttttatcagcaaaacaatattaagaacgatgaaaaagggtacaaggggtacccaacccttaccgtatgtctctcatttatcttaagtttcatatagaggaacacaatttatcaattataaaaaatacaaggatcgaaattattgtttttaaaatagtaataactaaaattaattttgaccaaaaaacgagaatttataatacattttatccttccgaattgaaaaaatttaactcagttgctagcattgtcacaaagtgacagtgacagagagtgtaatatatatgatatggcttgtgacaaatttaaaagccgtttagttccatttgagtttcgaaaatgataacgttgggcacgcaatgatactgagagatgcggtgggcgcatgagtttcttaatcatgcaagagtagggacaagcacatagaagtgctctatgtatgagatctaaactgcaaaatgtatgtcctaccagtctaccacatttccttcattagactaattttgtagtaattaattagtcataacaaagtatgtgcctcggagatttttatacccatttaggcaaaatacaaaacaaatttccccaagtagctatttttggaaattatttatcaaactagcaatatttactgttcatggtgtgaatgcgggtccagaattcacgcctccccctatggaaattttgttttgcaaaactttggtcggcaaaactcaaattctgactctgttttctttttcttttttcttttttaactaatgtattttggttgaattaaaa

SEQ ID NO: 6192 - DNA, 1447 bp, Glycine max
  Soy_ogl_2776 Gm08:20790716..20792162 Cluster 27
ttgtttcaacatgaaatcatagagttgaactatattgataccatgggcaaagttagaataccctagtttttgttgcagtgtctgccatggtacaattagcaaaacagtgtgcattcgtgggaccttctgtggagacaattactagtgaaaatgttttggcatggccacaagtggtgagtccactaatgttacttccgctcattgattttttacttttgttttcaactttcaaaaaatgaactgtacacactacacagtccataggatatacaaacattattatcagcttgtaagtatgatctgaaatttagtgttgaaataggattaaaaggttggttaaattaatgctttatcccatttgaagtgagatgaaagtatgttctatattgacttcagtgtcttcacactaatttaggtaggttgaaaagccaaaccagatcatgtggtttgattggaaaaccaatgaactagtctattaggttccattcaactccataaaaccagagtggtgaaaaactgttgaaaaactaaccaaactaataacactaacaaaaccaacagcttattggtttcaaccttttttgaagaaaaaaaatttaactcgaccgatttctttttttggccaaataaagacccaatctcaacctacaaaggtcctcaaatgtttaactagcaagtatagcctactttatgatcttatctccgttcttttttaattgtcggatttttgaaaaaaaattgtttctatatatcgttttcaaagtttaagataacattaattactctttagttaattatacccttactttcccatcaatatttaattaatttgatacgtatgcatttattgtacagtagaaatgaaaaaggataaaataggaaacaccacgactattttattaggataaacaaaatttattgcatttcttggtttctagtttcgacatagaaacttagaagatagataaaaaggaatggatggagttcttgtatatttcgcttattgtccaatgtgaaaccttgaagctctgacataatgagtatcctttattagttttatttctagtgaccttttctgaatgatttttatttggcctttcactattgctttttatgtttatgaggatatgttgttgacagggtgtaaaatatagcatttacaactcttaactggcagtaaataattttgtctgtatataattattctgtttccttttctgtttagtctattttaggtagtttcttattatgatttattctttccttaatttaggatttccttcctaaattgtagtcaatcacatgttgtaattccctctataaaaaggaggaatccttgtacagttaaaatatatattacaaaatatttcaacttggtatcagagcaaagatctctacgcctctgatttgcaattgcagccatgattgacagttcctcagccaccag

SEQ ID NO: 6193 - DNA, 1019 bp, Glycine max
  Soy_ogl_4728 Gm14:7027201..7028219 Cluster 27
ggggggggggggggggtgcgtttggtgtagtgtggtggtgttgggtggagtcgtcaagcttcagtgtggctgccatggaggtttgagagagaggagggagggttttgcttgggagaagaagggtaaatataagaaaattcggagatgcaccaagcgaaaaaagggtacgttaagtaattgccaaactttttcctttctaaattgtctaaaagcccaattgaaattaaagcccattatatttgcaagtgcacgtatcctcttggacaagagaaaggacaccaagacaataaccaaaccattcaataatcaatgacaaaaaatcgatagatcatgcatttattattattagctatttgtttgttcgatgtccagcaataatttattgaaataataacattaaataaaattattatatgaagatttaaaataataatagaaatatacataaatgatcgtaaaacatttttttcaagaaaagttaatctaaagttaactttaaattatttaaaatactattagggactagttgcataaaaaacttctaagcatattaactaacaccattcaataactaacaagattccaacagttggatatctaatttaacaacatctacttctaaagaaatattagactaagtaatatataattaaattgaatcaataattgaacccataaagataataattcaagattcgatggtctaattataactgaatcgtagttataataatttattaaagataaatgttagtaatacatttttaatacgttctttaacattagctattttttaaaatcattaaattttataagtcttacttctcattcaataagtcatacttagaattttatagtttttttttataaattttaatcaataatagaataaatgttaaaaagaatgtattattatttactgatactgttcttaaaataaaagtttaaatatttttataaattagagataaagttcgatctgattttaaacaaattattataaatattaatgattttat

SEQ ID NO: 6194 - DNA, 1400 bp, Glycine max
  Soy_ogl_1642 Gm05:31556901..31558300 Cluster 27
cacaaaagcacatcaattggactagaagactatataaatatatggaaccttatgtttcaaagtgtcctagctagatctccatatctgaattatagagaccttaacattggggtaaataataaaaatggctacacaagctacaaccaagccagtatttggggtctttaagtatttcaacaactttaagagattggcaacagtgaagaccaaggttgatcctcaaaacttcttcagaaatgaacaaagcataccttctcttgtgtcgaagggacgcaaatagaattccttggatataataagcggtggatcaccacctagttcatcaagcgttatttcttttatgcatttataaacttaaatacttgttatatagagattagttgagaccattgatatgtgatgatacaaattaaaccacctaagatatttttgaggaatatgaaacccaaaacctcatttttaaacacaatcaataaaaaattgacaactaattaaactaaagactaaattagtcacatgatcttttatggttattttatgttgtaatttcatcttttattttttaaaagatgaaaaatggtcccttagttattaaaaattataaaatgatccctaaagtaatttttttattgcattgtttatcccaaaaagataacgggaaatatgttatgaaaaaattacttaagagtaataagtattgttaattttaaaaagaaataaaatataggtattttaatttactatatctttgtcactacttagagtctaaataattctaggttagcccttacaagattttataaaacctatagaagaccattaacaaaatttggaaaatttgcaaattggtccttaagaaatggatataaatttttttgaaagtaatggaccaaataaaactctagtatcactaataaaacatattctacctaaacttagttaatcggtatcagttaattttagcttgattaaaaaataatgaaggaaattttagtcataaatcaaattttaattaaggattaattagaacattaggctgatcaatgagatttcacctgttgcactaattgtggaaattatttactagctagatgaattagttgagtataaactactaatttttatccttaataataacgatccattggccaatgatgttcgtttagaaaatgagaacagagaggagaaggacattgttgatgaggacattaatgaggaggaaaattgatgagaaagaagacaattagaataagttatgtaagtcgacaacaaacaaagtggggcagtttaatttctccttatgcaaatgggcctcatgacaatccattttctgtttaaagagtgtttaatggagtgtctgtttattaccttatactggtttacgtcttcttgtggtctta

SEQ ID NO: 6195 - DNA, 1300 bp, Glycine max
  Soy_ogl_3413 Gm10:8672601..8673900 Cluster 27
acaagacgaaaaaaattacacgacaatctgtagtaagtatcaaatccaacaatagacatgttcaatgaatctcccacgatgaacttagattttcttgacgtagttttcaattcccatgttcgaattgagttttcaatgccccgggcgaaaagcgtattctgtgtaccaccgtcaaatatctttttgaacattatccctatggatactaggggattcttctgactttataggatataaatcagttatcagttacacaagatgatgacttgtacattctactatataatttttaaattaagatagagctttttcttggtactgaattaagataatgctttaaaacaatgaaatgaataatttattagctaattaaattaaaagagattttgaatttaaaatgattattttaaatgacattattctttaatgaaaaatgtgtgtgtctgtacaaatatctttaaattagttaattttctatatataaaaaatgagtttattttgtgttctgaaaaacttagaatccgattcaaaatgctaaaaacgaacataaaagagttttgtacgaaaatagaaaataaaactatgtgctcgatagttacatttggctaaagttttcaacaccaataaattatttaacctattcgcttctagcattagtatttttcttttttgaacaccgggttcaatttagagactttcagggtttagaactaatgttatacagtatttggttgtggaaagaaataatgagaagaaaagtaggataggaaaaaatggtttagggtttgtaataaaaatatttatgcagaaatttatacactaaaagtaaatccaacttctaaaaaatattaaatttgttgtccttatatttcacataaacgaggtgattttgatttctattgaaattatatcatatttgttgaatatgaaaattaaaagtaaataaaatatttttaaaatataaaaatatattttttaaaaataaaaaagtataatgttaagtttatattatatttaatttatcttgtcaattcatagaatcataataaaataaggctggccaattggcccgccgaaaatgaagaaagtcaccagcaaaaatactgaacaatgaaggccagtagtgcgctggctgcacaattcttatcgttcccgagactgttcatagtggcctaagtaggagaaggataaggaaaaagaaaacttagacctggcccaataagtgtgtgttaaaaaggttggggattgttaaaaaggttggggattgctattagctccactcccattcttattggcccct

SEQ ID NO: 6196 - DNA, 1283 bp, Glycine max
  Soy_ogl_573 Gm02:15753501..15754783 Cluster 27
catctaattctaatttttttttaaatctaatactttaagttagttacaatttaaactattactatttcataaaaaaacagttagaatatttaatttcaaaaaataaagaattatgataaaaaaaataaatttaaaagtaattttatagtaaaataatatattgtggaatgatatgtatttaaattatatcatcatacaatagtagtgtgcaatgaagcatgcattaatgaatccaagatctcttaaaaaaatgaatccaaaataaatgtagcatgcattaattgtttttcatgcaatatttgtgagtgtacataaataatttaaaaatttcttccaaataaaactactaatcaattatacgaaagaagaaaagcaaatttaagtccattgactagtttttatgttctgccaaaattgagttattgtctctaacttcgatatcgtgttactatacagttttggcttatttaagttggatgataaaaagggctacaacgtcaatcatcaattgaaatacatgcattatagcactcgtgaacagaacaaatataattatactaattatcggtacataatataatctgcactttatctagcttatctatgaaaacataaaacaatttggaggataaaggtgaaatgaagatgcagaaaatgatatagatattaattgaaggatatctaattaatcataagaaagtaccttgcagcccttccagatgtagtaaaacaaattataatagatactttcaccttaatcactgctcctacgtaacaagtaatcattagcatgtaagaagcacacctaagaatctaccacaccatgccaataaagcaaaatgtaaattaccatagaggatgcaatacattccaagtgagtcatgggttctccaacatacttgattgtcctttaaaaataaaggtcttgattgaaaactttctcatcctacaaggacatgaaatggaaggcagagacttgagccaacgttttgtgggacatttcaaataggataacaactcatgattcaaaggaattcccaacaaatgattagcaggagaatgccacactgagataaaccaccataagatagaaaaaagtaaaaatgggaaaaaggaaagggaagttaggaacccagaatagaaaacagaaaatataatgatttagcaccaactttttaattaattaatattcaagaattctaaatttcatctaaaattaaatttcaattaattaatattcaagaattctaaatttcgtctaaaaataaatttcaagaatttca

SEQ ID NO: 6197 - DNA, 1256 bp, Glycine max
  Soy_ogl_582 Gm02:39508232..39509487 Cluster 27
gtctacgttcatcattttcgtatttaatattggaaaaaaatatcgtgacataaaattaagcctataaagtgctgtgttttttcggttcgagtgacgtggcacgaccatgtaacgtgattgatcgcacgttaggcttagcacctggcgccaaccatgtttgagctgtcattaagttgatgatcgaacggttgctattatctgaagcgaaaatcagcgccgtccacatcagtccaaaatccaaatcattcttcacgttttggcgtggcccacgtttttctctttggaattaaaactttgtcacccaactacgcaagagagaaggggttattatatggtggtttttgcaccatcatgcgttcttcacccaattgtggttttttacttcggaagtgtttatttaagtaaaaaaaatattatgaaaacagggtacttttacaatcaaaagttatgaaattaatgtttaagaaagtagagtgtaataattttcaccgatgttgttctatttatataattaagaatcaaacttctatcatatatttaaaaacttcaagcaactaatcatttgtgtcatccccgacttttgggtgtttatatttatgttaattgattacatggtctttctcgtttgtttatgttttttctgtgatatatataataaaatgtaattaaaatctttgacttaatttattttcttgtaagatataacagttatggagattatagtattacatcatcatttttaatcactttaatagaagtctttaaatttttagtgacatgatgaaatatttctacaaactttggcccgtaaaatatttccttgtattcttttattatttatttcatatttaaaattaaaatttaaaccgtgatatgtttatgtaagaaacataaagtattattacatgtttcaagtagtatgctacttatacataataatggatgggatggaagtttcataaaatattataactttgcgtcacatccttatatttattatatctaacggtcaccaaaaatgcaccaccgccggttatctattttctagtcagactatcatagacaaacggggagaaatgtttttttcattttattatttcttttttcgtcgagtagcgggtgcacgattgcagtgtgaatttattttttgtatggaaataaaaatttgagataaatataaatttatctcatttcaaagttgacatacatcaaaaattttatttaaatgcattgaattaagatagtgatctaattac

SEQ ID NO: 6198 - DNA, 1500 bp, Glycine max
  Soy_ogl_2365 Gm07:19080201..19081700 Cluster 27
ttcgcacagaataactgccatagaatttagagtattcatgactagaaagttcaagtattactaccaattagggatatataataaattggatactttacttaggaatgaaatatgcaagatcaacctacataagacacttcaaagatggctattgcagttatgtcgtgattcttgctattatgagaaattatggacaaatatgatcgataccatcacacgtgcagccacataaaccttaaataccttgatgatgttgcagccaagatcacagttacgttgtttaaaacctcgcctccttcataataactaactagtcgagttgagactccagaagcattccttaaccagcgagacttgtgtacgtagtaatattatgcaacatgtaaaagtctacggtaagaaaagtggaatgatgtaattaatattttagaattcatatcaagggatatactcatgatatttatagtaaatgccctcctttgttgggaatatatggttgtttgacacatggaaaccgatctttctttttctagtccatgatttttaacatattaattttccaaccaaaagaaattagatgaaaaacttattaacaagatacaaagaaaagcataattccactgaagttttagtccaaaattgtagagacaaaaacagattaaaaatatatgtgtaggaactaaaataatttaaaaagtatgtgtaataaaacgagtagtttataggtagtagtatctatacaaatactaattaatctaaattgtagagacttattgcaacatgtacaagtctacaataagaaaagtggaatgatgtaattaatatatatcttagaatttatatcatggaagtttattatactcacgaaatctatagtaaacgcctttctttggtggggatatttgtttgttttacacatggaagcttatctttctttctctgatccatgatttataacatattaatttttcaatcaaaagaaattagacgaaaaacttatgaactaatatataagtaaaaatgctgcacgcccaaaggacaacctgatcaataatataatgtgaatgtgggtaaagtcaattttgttacaaaagtcagcaaggaacatatgtaggttgcccatgcattcacgctagagaaaaaaaaatttgtttgcatttatatatagagttattccaccattcgtttggtgcctcatatctagtctataaaaaacaattagcatatatgtatttgactttatatccaaaaaataggggttatgctgccagattttttccaagtttgtgtcgcattttttttagacggtagcatattcttattcgacattaaaatggattgtaaaacagattttttcaattataaaatggattgtaatttggatatacgataaggttaatgaagatagaagaaggtttgaaagattaattttttaatggggttagggagtttgcaaagtaggcaatggatccagaagttcaatgattttaagatacaaag

SEQ ID NO: 6199 - DNA, 1420 bp, Glycine max
  Soy_ogl_3430 Gm10:36959101..36960520 Cluster 27
attgaattacaccaaagaatttcacgcaagtatggcagcattagtcatagtgcgaggtatatatttgcaagtgcattatgacgttcaaagtcctgcttaagtagaaaaattaacactcagagtaatatcctcctatgctataatagttaaatagaagagggtagcttttaggatttaagcaataggaactaattaaatccaattacacaactaatttgggcttgttaggaactttaaagctcaatgacaagcaatatgtgtggtcaattctttgattctagcacgtgctgtgtaactgtgttgatgaaagtttgcattttataatcatacacgtatactcttgtactaacaaaaaatttgtgaacggatctttatccaaaagacaaaaaaattgtaaatggattgcatatttctttgaaaattagcaaaacaaagaaatatttactcttacatcataaatttgattttttaagaggaaatttgatttatttataggccatggttcattaattataagaaaaaagtaggcgtaaaattattaatgaatgagttaagtcatgtttgagtaaacttatgggactccaaaactacatttgaaaaatgaatcaaaggtttatttatgcattaaaagtgcattcaaatgcatgttataataacttagataataatacaaataccaatagctcaggacctctatattgtatttaattcttacacataaaaaaataaatgataatccaaacatatacttagtataataatacttatatgttcatgaattttatcgtaattttgattcattgtttatttttcccattaaaacgattttttttttcttttttgcgtcaggctagccaaaattttaccctacatgcatttgtggatagaataggtctgctattgtaaacaaatggcagccgcacattttttttggtagttggatgaaagaaagaaaaaaacgatcgagaagcataataagcttaaattttaggaaaaaaaaattcagccacaaatctgttttaactttaacaaaaagtaaaattataaaaaaaatcgtgatatacacttgtgatatcatcacaataaaccgaacccgattatttgaattggtctattaaacatggtttatttgacacttctacctatgctatcatatttttaatattataaataaaaatatacatacaaagagtgggttttattatgaattggttgtttaaaaaaagtaggtttttattatttttcattctctcaattaaatatcctcgatattctttttctcttttaagtgtatatttacattattcttgtgattagtaaaaaaaactctctcaatcatatcaaattattttattttatatcaatgagtttgctaacaacaaattcctcgatgtttcttttctaacacattctattttat

SEQ ID NO: 6200 - DNA, 1332 bp, Glycine max
  Soy_ogl_4738 Gm14:13150069..13151400 Cluster 27
gtacgagaggaaaatcatatacaattgaactgaatttagaagtaaactcgaaagatgtaaacttgcagtatatggttagctaaagtagaaagccaaccaaacaagatgaagaaatgaatatcagagagcgttacatttcaataaagatctttttggaagtatgaaaatatacttttggataggccttctgggaagagtaaaaaaaaaagtgtattttgaaaaggtgtttctaaaattatacgtttaaatttccagaagatcattccgaatattttttaaaaaagtgtattttggaaaggtctttagaagagtaaaaaaattctgaattttagaaagatctttctagaatagggtcaagttttatacctctctcgttttttacttcgtcttcatttttattttctgcataagggtcatcagcgatggtgctcggtggttgtgggcagtggtgtttcgatcgacagtgggattgggtggaggtaggatatttgtgtccgttcaggtcaggggatgtgcaggaagtaaaagtccaacaataatattgctatattattggaacttttccatagatcgctattaggccataacttactacaggagttagattgagctgggcgaaaagaaaaactgaaagtgaaaagataccattttgacgtacattttgggtcatgaagttgatattcgggttcggtcgaatttgttggggtataactaggcaaattagattttctcattccacgtttaaattaggcaaattagattatcaattaaaagttcaaaggatgaggattaattctagtctctagaggtagttttgtgtttttattttagttgttacttagagaataagggtggaaatagattgggcaaaataattttaaaatgatttaaataggtttgatctacttaaaaaattgtagactcaagtctgacttattatttatcataagcttaacttttagatttgatcggtcctagttgaaaacctaaattgacttattagcttacttaacaacttatttcatatcaaaacttctatatatgtctaacttctttttttatagactaattgattatagggattaaaagtttaattaaactaataaaataagattctcctactttttgtagagatcgggtgaagatggcgagcatttctaacctactctcaccatacataactgttataattaagctcacatttccacatcactaaactttgtaccttgattttttttcctttcttttccagtgaagattttgggattctagaagcaatatgcccttgtttaaaagcataaataatgatgttgatgttaaagctaataatga

SEQ ID NO: 6201 - DNA, 1100 bp, Glycine max
  Soy_ogl_4781 Gm14:45674301..45675400 Cluster 27
accattatagttatacatatccaatcagttactaaaaagaagcagaatattagaaagaaacaagtagtcatatataattaaatgtaatgaatcaattttgtctcatgcagaacctgtcaaacgccatagaaaatccatgaaaaagaagcagcaacagcagcaaactaatcaatctatagacgataaagaaattaattatatcctttactagtttttattattcccacatgattctaatatttctttatataggggtatataaaaattaatgcttaaaacttctaatgagttaggctttcaatgcatgtaggagttagcaaactacgcttgtgtttgaattgcagttaaaaaaaagagttttattgaattgaactttataaagttaagtttaattaaaagtaggttgaatgtaatttgatttgtgtttggatacttttgttttaaaagtatttttatcataacataagcttgtttggatgatattaatgaaaattacttttaaatgtataattactaaaatggatatgaattttataatattatattattaacatttttcttttattcaactttaaatatacttttaatttttgaaatgcaaagctgaattttattaaaatgaaatgtatgccctcaataaaactccagccacgttgcaactctatgaccccttgttgtgcgatcacactaacattcgagactaattaatttcttatcactaaatttatttattaacatttttatcttttttaacttcagatttagttgattttttttataaaaaaaaaaacccttcaattctaatttcttattaacttgttacctacaatttacttggccaatcccttcccctttgcgttttcccacttccctcgtcctccccttttttgtcttctcttctccgtcctctcacccgtgccaagagtcagccaccactttttccgctatgtcaggggtgcaaccaaacaccgacggatttggacccgtgtcaatgagaacaatgtatttttttttttaaaaaaaaaatctaatgaaattatcatatgaaaataaaaataaatgttaaaatcataaattttaagtaagaaaaactgatattg

SEQ ID NO: 6202 - DNA, 1326 bp, Glycine max
  Soy_ogl_5413 Gm16:33856301..33857626 Cluster 27
tgcatagaaaagatagagagacaaaaataagggtgcaataattgaaaaggatcatatactaatgctctcgtacgggggccatgcaagagaaagacatacaagtatttaactagagttgtgtctcattgatacaattgaatgatatgataacaaacaaatttaattagcattcactttttaaaattgtgtttgatgttgatgttggaaaattaattttggattatgctacataacaacatattaaaagtatgaactgtcttataattcaaaaaacgaattttgatttttgcatacaggtcaacttccttttcataattttttttagccaccaaagaaaacaaaaggcttggggtcaattgctgctcagtctacgtatatcatatcttattcagatcatttgggaaatataaagaacagttgactaggtgagagaaacatggagaataaacaaattttaaaattaatcattatttttttttttttcatattttacacttatcttgcattcatgtttatctttttcctatttttctagtagaaggctacatattacaggaaatatttaagtcgaatacagttcttatgggcgttaattttatttttagaatatttaatataactatgcatctaaaactctaacttgatatcaatagtaatttaaattaaacattatatgttacttttttcccttattttttttcacaacactcattaatttagtcattttcttctaatatgtaaaattcgtcttctgtttttttcttctaattttccggttatgtttctacggacggtacctaaaattttcacgtgtcttctgaagatatgatctcttcaaaccacagttttcacgataatgagaattactactttactagttaatttcaatcattttgctaataaaataaacctaggtgccgcaaatatagatctctaatatttccattttattgtggttttccttcatttcggccttaggtgtaacctcgttttcatttatttctccgcgattagtattatttggtgaaggtaaacttggaaagaagaaaaagtacacgtgtatctatgagattcaacataactttttgccctattttttattactaatatttcctccgtattaattttctaattgaatattgttgacaagtcataaaaagaaagatgattacgatattgtcattgattaagaagagacaaaactcaacacatgaccacccatgtatataaataaatatgtaaaaggtgaaagtaaatattttgggttatgtcatactcatctaattttcttatatccaaaaacactttcttacaatatttttatcc

SEQ ID NO: 6203 - DNA, 1400 bp, Glycine max
  Soy_ogl_6705 Gm20:23501101..23502500 Cluster 27
ctcctcaagtgcaagcttcttgcgtagccgctcttggtgctcagaaaatcccaaaaacaaatccctcttattactagctattttgaattctttagttcctgaatgtacaaccttcaaattgttgctcgttcccctctttcttttctgcaaaaaagaaaatcaaatgctgtgaaaacatggatgaagtcctaagaaaatcaatatcaaagaaaacatggatgaaatcacaattaaaaagcacaactacctatctttcagagtcctttggttaatttgtcttgtcccctcgtctatcaagttaaaaccatattttttcttttacttaatcttttaacttatttcctattattaaattgacaagagtttacccaattacaataactaacacatggcagggctcaaagctattgattaatgaatcattacctgaaatacaacaatttaaagaaaggtccgttactttgtgggctctcttttctttgtatgtagttatcatggatatgtgtttatagtacttaatcatgtttttttatttgctgtaacaacagagttggtgttaacttgcctattggggttctaacgtaaagctcttcataaaagggttgtagcctgtcaaatcatcacaatattcaaagaaagaaaagttcttttacaaagtagaggtgaagagtctctttgaaatcaatgacattaccacggtactctgttatatgtattctccattgcttaatttgacatgattaattgatcaagccaactattgactattataattacttggctgaataggtaacaaattgtgttactattggcactattggaagaataatcgtggagagtcatggatggtgttatgcatcatgcatgaagtgcaacaagagtgttgtactagaaaatggaccattcaaatgttcatgtggcaaatacaacgaagggagtatattaaggttgtgtacttttagtttaccattacacattaaattagattttattttattgttaaattcttttgtgagccaattgtatttgtgtgtaaaaggtataagctagaagtgatggtgtatcacaaaaaacaaacttctaattttgtgctctggaaccgcgagtgcatagaacttataggtaaatctgcacaagaattaaacgacatgatgtttgttgtatgtgtttatatgtttcacttactcctatttttctttttatttatattattatgattgtttccctaatatgttaattgttttgtttatgtctatctaagggtggtgataaaagtgttaatgtgttcctagatccactcgacaatcttttgggttgtactcttgcatttaaaatcaaggtccaacccaaatacaggaattcatctgtgaaaaatatatctgatgatcctgaactcatgc

SEQ ID NO: 6204 - DNA, 1100 bp, Glycine max
  Soy_ogl_2433 Gm07:39112301..39113400 Cluster 27
aaagttggggcatgtcgcccacggcccaatggaccctcctcaaaatacccccacctggcccaccaccatatatccccgatactctccacaaagcttgttagttccacttatttggctccatcccctttcacaatgccaacctccagcaaattaattaatattaatatgccttttatggtgcaattaactatatggatcattgtaaataagcaagtttttagtataatccaaaaatctagttcatttttggaatagaaatattaaacaagtttacaaatgctgtatacaaactagaaacaacctcaatttttgcaaaggcttcatgaatggcatattaaaactattaagtaggtataaggagcccccactcactcctttttctaataaagtcaaagaccctttttcttcctttaatgtatactccacaaatcttgttcatttttggaattgaaagataaattatattcatagtttttgcactactaaaaaagccctctacaaactagaaagagccttaatttttgcaatggcatattacgaccattaaccccactcactcttttcttccttttatgtatactccacaaatcttgttcatttttgggatagaaatactaatcaaaacatttgcccaatacaaaagccgtattcaaactagaaagagcctcaatttttgcaatggcatcatgagtggcatattacaactattaagtaggtataaggagcccccactcactcctttttccaataaattctaagaccctttttcttccttcttttttcttggttcctcttttttgagatgggaaagatgcacaatttcagaggcccacctcatgatttagtcgtaagaaggctttgcaaaacttaatttgctcaagaatctaggaccataacgcatgggaagtgatagtggtgcgaaggtgggacaatagtgttgggaagccagtctcttcaatgtggtagggtttctgagtttgggatcattatgctcttctaaggataatttgcaatagtgtgtcaaaaaaatggaagtcataagagaactgatggaagagtgtagtctattgccagaaagacacaccctaagtcgcaggaat

SEQ ID NO: 6205 - DNA, 1000 bp, Glycine max
  Soy_ogl_2072 Gm06:44324701..44325700 Cluster 27
tagttatggaaggaccatagtttctttcccacgatgaatctttaagcttggtttcttcaatctcttgaaaatcccaataaatctaaatcaggatttggtacaagaatattccacttgaaaacgttgtttaggttgaagaaggtggcaactcaatcgatggttcctcagccatcttgaaactataccattcgggaaatttgttacatacacattgttttttacatagaaaatatactccctccgtcccatgataattctgggtaacgaaaaaaattattttaaaataattattattttaaccttatcattaatttttttttattcttaaatctcttataatattaatgatataagccacaaaaattaaaaaattaataataataaaaataattttataaaattaatattctctttcatctatttattattaatacttcttagtattggtaaaacaacctaagaggagaattataatggaatgaagagaatatttaaaaagaaaaaaaagaaaaaacagacatattatgtgaaatagtttagcttatttaacttatttttaattctatatatggaacaagagtaccatgaaattaaaaggctaaccttatcctaatcttaaaattaaactgatacgaataatgttcttttcttttgaaacttaagaaaaaatcctatacgataaatttaaaactaaatttcaaatatttaggcatatactttccaattctccttgtgctaatatctatttacacttaatttgaatttcaacttttatgaactatatttctcttcactcactctttcttgtctctcactttatcataaggtgtgtggtttcttaaagttcactcctttcaatgttaataacatttaaattttatatatttttcattttatcactttgccttccttggttctttttctccttcatcctctgcatgatgtgctcagactctgaaggtattgttttgcccttcaacaataattgttttgttttgct

SEQ ID NO: 6206 - DNA, 1000 bp, Glycine max
  Soy_ogl_4028 Gm12:9436201..9437200 Cluster 27
atatgttgctacctcaacaattttcaaactgcacaaaaccatgattttgacataatttctgtttctgctacccgctatctttatagacacaaacaaacattaaatcatgatgagtgaacaaaaacaaacacaaattttgaatgacaaacaaaaatcagagtatccgataacaaataacccacaaacaggacacaccaggagaaacactagatcgagtcacggaggatctccatcgtgtatgcctcaccacgctcctcggcaacgccgtcctcctgtctgacgcccagtgtgactcccaacaccgccttccagaaacacatcgcaacattggctgagattttggcaatgagaatgggtgatggacaagatttggggattttttaggttaattagaaactcgttttttttttttaaaattttctcacatgctaattttttacggagaagaggattaaaaagaatatttttaaagtttgaagaacaaaaaaatatatatttgaatttaaaagattaagaaaaatataacatatatttgaaggaataaaaatacatttaattttttaagttttaatcttttttcatgttaagtgatcacgttttaaaacagaaattactaatatttctgaactaaaataaaaaaaattctaatatataaaagagatttataggaactaaaatattgaaacaaaaaaacttaatttatagaaaaaaaatggaataatcgcaacacattcttagtagtgcatattttattattaattaaaatttattaagaattataaattaacagagagatttattaaattaatagtgagaccaaaaaaataataattttcaataaattttaggtgataatagatagtttattaaaaaaaaacgagaattagacaatttgtgctagcactctcaaaaaataaatagactaaacaaaaacaactctatattttaaagaccaatacgtgtaaattaccgatacccaataggcatctttttcctttac

SEQ ID NO: 6207 - DNA, 1300 bp, Glycine max
  Soy_ogl_6016 Gm18:10648001..10649300 Cluster 27
tttagacaataaatattttttctttttagttctttaactactctaaggacacttttaacaatatcattaatcttaagtttttctataaataatgaaacttactatacaatatttcacaatcaagttacatgtcaatgtccacaccagccaacactaagctaccaccaccacattacagcagaaatcgcaagtacagcatcagccaattttataataccacttaactcctatttaaaaattcattaaaaaaatcatataagttaagaagcaagcaggacaaagaagtaatttgggattactataaagtttgtaaataatatatattggttaaaaatgttatgatgttcccttcatagggagactcgaatatgttgagtataaaataagttggacaatgtattagtattctattttgaaatatcacattttttccgccaagaaggcaaaaggaaaaaagttagtctacttagatgttataataaagaagaaaaaaaatatctaaggtcaaattaaaatttctcttgtgcaaaaacaaaaaaagcaagatgattggtttaataggtattataagtcaagaagatcaattggttggttgaacagaaggcatggccgcatgggttgttataaatcccttaacaaacaatgtcttctatcatggtagataaaaaaaaatattacaagaaaaatggcaggaatagaaaacctttattgtaattaaatattctttaccgactaatattgtggcaacttatcaaaatccatgctcttgtttataaattcatagaaaaataattgtttaatatggtataaacaaaaaagaagtgtattaaaaagataataaaaaaagttattaatatatgattatatgcatgctaccaattataattaaaaaaaacatgggaccaattcttatctcactaaattatcaattttaaaaaaatcctattatgaactaattaaagataataaaaaatcaatcaatcatcatggttaacacacctgcttaatatgtgactttaaatctgatttcctttaaagattaaaaccaattaattaatatgcacaatctcttttaaaatgtttaaatctaattttcttttaaagcctaaaaccaatcaattaatgtatacaatcttctttttataaatgaactctgtcacttttttttctcacatccatgtatctttccttaaaaccaattcctttgaggtacagtggggtgctaattaaatgtaagcacggagattcaaaccttggtcaactcctacgtttttaaggaacgacataacttgaagttttt

SEQ ID NO: 6208 - DNA, 1500 bp, Glycine max
  Soy_ogl_1998 Gm06:17069801..17071300 Cluster 27
tttctgatcaagtgattcgtcggtcattttctcaacaaaacgctattctgaaaaattaccttaaaacatgaagatcagcaattttttggtggtaattaacggtccatgtttatacttgaaaacaaattttcacaaactgcaggaacacaagtccattaacataaacctaacctacaactttagaagaccctaaactctattcaagctagtaaattttttacctcaaacatgttcattttttttacccacattaattcttaatttcttttattattctcgaatgtcgaagtatttacagcacaggtacttcaattccagcctagctatttccaacggtcattgcacattgccctatgaccctatggtgtgatgttgtgattagtttgtcccaagcaacaacaatttaccacagctaaactatttaaatccgacaaaaagatagtattgtctaaaacgctatcattttcattgttttactcgtatatgtatcattttttggatgtttgagcaatttactactgtgaagagaaacaattattgagcagctaacaggccaaaaccaaatcatattcaatgatatgggtctgcagcagcagcagcagggaacatatcagacgttgacttgtttaaataatttttcagattaatatacaaccactgacaaaagcgtaaatgggaacagagtttaatgcttaagaaaactgcatattattactcagttttagatggacatagtcacacacacatgcatacctaccacctacatataattttgtgtcttctcttaagatcttcatcaatcttgacaattgacatgttttctttcattacgtgcttcagttatttgtatattaattgcatattgttactcatttttagattactgtggacacagtacctaccacctaaatataattttgtgtcttcccttaagatcttcatcaatcttgacatgttctttctttcattacatgcttcagttatttgtatattaattgcatattgttactatgttttagatggacagtggacatatgcagtcacctatcacccgtacatataatttggtgatataaggttgatttagtggtgaagggagaagggaaaaagtagagaggtcacagtcccttaacaaaaattaataagactaacaactaatatttgttgattccaaaaaacaaacatatacatataattttgtgtcttccttcccttataaattaattaaactggtccaccttttacctttacctccaaaagctggagctgtgagtaaaactatgtactgcaacacttgtggagacataaccaaccaaaatcttcgtttgttttgggcagcttagaatgcacatgctagttgcagcagcaggtcatcaccagctaggacaaacacttaaactgatctccaacactacatgtgagggatgtggcagtgtgctgcatttttttgcattattattgtacctctctgactatgcccgttgtcacatgtactaatta

SEQ ID NO: 6209 - DNA, 1058 bp, Glycine max
  Soy_ogl_5994 Gm18:8451266..8452323 Cluster 27
gacagtgtaaaactgttataaaataaagacacaaggattaaaatatataaaaaatactcaaatggaataaaacgtaaagattaataactaaaaccaaaaattgaattgtaggtatatataggaacttaaagattaattaaacctaaaataaaacttttcatagaaagaactcctttattacttatcaaattatggaattcgcaaggtaatgacacgcgcgcatggatgccacacttggtttttttgtttacttttctttatgttgtgatgtgggctgcagcagcagctctggtagtaggaactcttccagacaccccaggcaaaggtgtctctctgtcacattaattactatcagtcaagactgggagtggagggggaagtggtggaaagtatgacttagaaatttgttttaaaagtttgccaggttcaataggactcgtatacagtgctttgttgcgatgctttaaaaacaagttccctgcaacaagtagaacatcaatcaagtcaacaatgagggcattatagattccttattcatataaaaagttactagttctttcccagacttcttttttattagggcacataataaataagtcaaagaaaagtagtaagacctaaaaaatattgtcaagtgacatggatacggagatataaaattaatataatattaaaaaaggtgaaggaaaaagaaaagaaaaaaaaactcctcattatcatttctaacaaaaattaacaattaaactaatatttattgattaaaaaaaatggcatcaatatttcaacattaatagcgtaatctaataaccaaaaccatgttggcaataatcatgacttaatgaagaatgtagattacaaaaaaaattgtattacatccatttaaaattattaattagtttgcacgcactttgcattaatcacggtgctgctactagcctactttatagtataaagaatgagtatgatcactgatgagttctcatcattatcatgtaaaacaaagggtcgtttgaattgaaaaaaatattgtctgtttttatttcttatttacaaatcct

SEQ ID NO: 6210 - DNA, 1000 bp, Glycine max
  Soy_ogl_113 Gm01:36173701..36174700 Cluster 27
cctattattcagatcagtctttatctttttagttaaaattacattttatcaattgtattcagttgtaacaaactagtctatataagaagagtctgtacctctatcaacaacttttgcataacattgaatcgatcctcaacttcctcaatcccagtttcagattcccaattagctgttgcactcaacaaccatgccactgtcaagctcaatgatcacagtcaaatcaatgccctcctcgtgtggtatgacttaatcggctttgttgatggcaccaactcgtgcctaaccctctcactctgattacacgtactggaaacaccaggatcaactaatcatccatgcaatcatatcatcggttgatcaaaatgtgatcaccatgctcgacaacgttcagacatccaagcaagcatgggacacccttagcaaaaggcatgccaacaagacacatgctagaatcatgaatctcaacaagtgactcactcgctactcgaagggcactcactccatggatgagcatctccatgtcatcaaatctctaccagataaacttgtgatcatcaactctccgctagataatgaggacttggtcatccacactatcaatatatttggtgttgaatactaggaggtcttcgttgcctttagaacacgtgaaaaacctattggatttgattaacttcattatcgcctctctgactttgagaattatctcaagagagatgaaatcaacgctgaccttgcaccttttgcaactgcacatgctgcacataagggtaagcaattctgtaaaataaaataaaaaatcttacactcaaaatcatggaccctccttgtataacaacaaatctagtcccaaaactccacttgaaaggtgttttgccaagactttgacaagcctggccacacgaccaaggtatgcttcaagctacatggctactccaagagaaatatggagcccacaacacatcatgcttgcgcaacgactcaacaaatgccaacc

SEQ ID NO: 6211 - DNA, 1100 bp, Glycine max
  Soy_ogl_114 Gm01:36555401..36556500 Cluster 27
gtcttaatatatggtgctttctctcttttcaatacagtttgtaaagctccattgttaccgcgcttgctacagaagtaaaaaaagtgaggtggaaaacatctctacatgcatgtcactccttgagtccttgcttcaatgaaagttcggtgataaagaaagcaaattacggtgaaaataaggggtgtggtgtggggtagtttaaaaaaaagttgtaagaataagcattttttttaaaaataaaataaaatagagggtcatgcctcaaaatggcatgtctcagactaagttggaaggaaattgtcagcggttttacacttgtctctcctatgccataacttattcgcagggcttagggaaataccttcactctccaatggtgtaaacctcgaatggtatggtaaaacattgaaatatataacatacggacaaaaattaagttttttttatatacttttatggtatatttgatttgagaaagaaaaaaaagaaagaaaataagtagaaagtaggatgattttataggatatttggtagaagggaaaaatgaaaggaaagaaagttaaaaaatttctttcttcatatttagttgcgtagaaaatgaaaggaatcaataaaagaaaaaaaaaagtatgcaaaaacaaggataatttggtctttgaaaaatataaacatgcttccttcttctttctatctgatttgaagggatgataaagtggagtgtggattccacatttctgtttcttctctcgctttgagagcttccaaacagatgaaagatgatacggttttcaatccttcgttaatctatccattgtcattcctctattttaaatagagcatttgtatcaaaacagtccagcgtagttggattccttaagcaatacggatagaggttagattttcttattgtgcatatgaaatttttttgttagaaacgataaaatttactttaataatatttagaccttgaaaagaattaaccttttactgtctgttaaggaatatccttggtacaaaccaaagaaaaaaatttatttgtgctattttccaatcagttttgatgttttactttggtaattatgttgatttttaatataatt

SEQ ID NO: 6212 - DNA, 1000 bp, Glycine max
  Soy_ogl_137 Gm01:41423201..41424200 Cluster 27
ccgttgaaaaaattccttctcaaaagcatacattgaattttcgctctttatgatatagctggtgctaatatgtttccattttaatttgttatctaaagggatccacgagatcgggtatttttttctcttgctagttagtaaggcttgcgaattgcaatctctggtttgttgggttacgggtgctgtcatgttatgttgatgaggcatgatactgttacatccatgtgtagttcccgtgtttggttttgaacacgtcttgtgacaaattctaaactttttattattaatatttttatttttctgtgagaaaaatagtaaaacatatttctctaccaccgaatttggagagaccgtgaattatgatggaagactcggtgatgtgtttggaaatgcaagagtgcaatttggattaagtttttttcgttttttttgcaatggaggagaaaggttagaaaaccgatcgaagatatggaatgcaattagtaaaaataatagaaagagtatataactaatcaaagatttgtgtataaaaaaattaaaaaagtgaatccaactcataatacagttgttctaattttaatagaccatctatgatggggttatatttcaccccatttctacttgggtcggttagatgatccctcaccaaaaacaaagtcaccaccgcaagattgatttgtccaaagacaccgtatctcatgatatttgaaattaatggtcaagttagtaacaataacttgaaaaaaaaaaatggtacaacatgccaacccttgggggctccacaagccttataattttgtgttgatatgagaagccaacttgcaagtaataaatattctaggttttttttttatatatataagcaataaatattctacgttttcagctttcctactaaatgatcatatttataatcttacaactgattaaacatatatctataatcttacgtgatcatgccaatctagaaatgaatttgattgaaagggaggcaaaatag

SEQ ID NO: 6213 - DNA, 1500 bp, Glycine max
  Soy_ogl_446 Gm02:8769001..8770500 Cluster 27
aatgagtaactgcagctccataagtcacaagagagagagagcattcttggagtcagattcacaaatgatagaataaaagcctttttcttgagccggtcgaaggccatggcagatccccaatagctcggcttaaaggactatattgaaaccacagcttcctaggaatccttctaaccattcattgaccacgatcatctttgaaaattccaccacatcttgaaagatctccatgttactagctctccaaatgaacttacacgtcacaacaaacttgatgccaactttagattctgcattgactttcaacgagctcctcgggttatcaatgattaagggattctgaaaatggaagtgaatcatattccaaatcctttgagctttgggacaatctctcaagacatgaaagatatcctcctactggtgaccacacttgatacaagaagagtcatgggacaaaaatatctgcacacgaaaaaagttagtagggagagaattatggcttgaaagccacaaaaactatttgatattttctgataaagctaacgtccaaacccacagtcttgcatcttgaaaattggggcaggcaagacgggctcgggtgatccacctataagcagacttgggtgagtagttttcgtcaaaagaaccatcccaaatgatagtatcaacaatgtcctcattcaagaagttactctcaatgaatagccttcacctcatcatagtcaaccttgtggcaaagagccccatgagtgctccaccggtcaaactacatagacccttttccttctcccaccctaaaccgaaagccaagctcaagaatagctgcagccttaagaataaagatccacaaataagaagtaccaggcttgatattatcatggaggatggtactttttttactaagaagctcaacccacaatttattacgctcatgaagcatagaccagacgtgtttccccaataaggaaacattcatgtctcttgcagtttgaacgcccaaaccacttcgattcttaggcttgacatagtgtccaacttcacccaatgattgtaccaagatccccaaatataggttctagttaatctatcaatttcatcacacacccccttaggaaccacaaattctgcatagaataaatgggaatggaatttatcactgactttgccaaagtgattcttcccgctctactcagtaacttagatttccaaccagcaagcagtttttaatgctatcaaccacatagtgaaaatctcttttcctaactcccaacgagaagaggaaaacccaaatatttatccaccttgacggtgtgattaaaaccaaaagtagtgaatttatcagttttaattctagaaatatttctagatgccatgaatctggatttctggatactcaccttaagaccagaagctttgcaaaaatcatgaagaacttgctgcaccaatctcacttgagaggattttgcctttgtgaataataagcaatcatccacaaagaaa

SEQ ID NO: 6214 - DNA, 1000 bp, Glycine max
  Soy_ogl_596 Gm02:41288901..41289900 Cluster 27
actcacctaaattttttctttatcaaaaaaaaaaaaaactcactactaccaatactactatgcccatccacatggaaggctttaagcgcaaccttaagcaaattatgcgcccttgtaatgatagtgtaaggaggcaccatcagttctggaataaagcttcattcctagccttccaaatctcccagagcatgatgagaaaaatcaaccccaccttctgcatattatctcaaacttaaccaagccacctcgaccttatactagcactagagggcaaaggatttttgcaacccgaccacaccacatgcgtattgccacagtcccagagaatatgcgctataatttcactgaacacccaacacctaggccatgcgtgaagcattagtgataatatgcctgcaccttaggaactctttagacggaagagcctcatggccaagccggcacatgaaaaacttaacgttctcgagcaaagaagtcttccacaaccaattccaaggatatatgctattcaagggaacttggttaagcaaccaattatatcccaagcaggctgaatatacattccccaaaaatatctcatgaccaaacaagtatgtcaaggatagatgagttaagagcaagtcttgtattcagaatgtcctccctaatatgggaagggagaacattgtagatattctccaagtgccatcccttgaataagcattacaaagacttaaatcaacatcatgaatatctatggcatccacctcccgtgccagtaacctattgccccaccagtgatcaaaccaaaagctacactcacccctcccaaaccacccttaaggatagggaaagcatggtttaaagaagtaaccgaataagaacctttatgttgaacgagatcttcaatgtcactccaagggtatttagacgaaacaggttgcaccaaaagcttattgggattagcaagacatcccaaataagttttctagaagcgccacattgagtcaccctcacccca

SEQ ID NO: 6215 - DNA, 1026 bp, Glycine max
  Soy_ogl_1609 Gm05:9801475..9802500 Cluster 27
gtattttttaagaatcataaacatattttaacctatatattttaaacacaaattaattttatttttgattctttcaaaattattttttatcacaatctttaaacactctttattatttgagtttttttatgccgtattttattctctctctcttcttttttttccttagtacagtatgaagataagacaagaccaagaaactaaacaatcaaattaaaatcccgccccagacgcagcagaacgccataggataggaggagagtcccactgaaacactgttgcatctgttgttgataactcgaggcccgccctgaaagataatcagcaacagtagtattctattaatttcttttaaattagttagttaatttttaaaaatagtcacgagtaaactgttctattctatatatcaagtcataagtattgctgtaatttaaacctttatgcgtatgtgtaagtatatcaattttaaaattaattattagaaaaaaaaggtcttttgaaaattgagaaaaaaatcaatgttttattggaagacaaattaacaaattcagaaaattaattatatcgtcatagatgtacttcaacaaagaaagacaaattctgttaacaaacgtttttcaatgtaatgtcttatctcactgataaaaaatatgtattatacttatttgagttagatatgtttgtagttagtataaatagtatactttttttaaagaaaaaattgtctttttagactcttaattttgaaatatatattttaagtgtgagttttatttttcagaaaatttacctttttacgatttctagatttaaaaatagagatcccgcacatttctaaatataggagatcaaaagaacatgagaagacagttttattcgaaatagaagcaaatattttcctaaataaaaagtaatagccgacattgtttatcttgatgtcttttgtggggaacgaacgagagagtgaagagtttgacacagacagatatttcttacgtacatcaatcagcaatggcattgtca

SEQ ID NO: 6216 - DNA, 1200 bp, Glycine max
  Soy_ogl_1612 Gm05:25588901..25590100 Cluster 27
cgtatagagagaagcttttgaagaatggtggtccaatggctttttcaacttttgatgggagatgttttgggtatctagatcagaaaatacctcctacgccaatatctaaggaggactttgaacgtttcccagaagttcctatttccgataaggagtttagtgactggtgtaagccatggaagggggtccttgatggtcatggtgatggggaagagattgggttttcagcaataggaggccaagtttaattgtgagtgggcaaagaatggtgctatcaagatcattgatcattgatgtgccaagaaactactattagattttgttcacatctgatgaggtgaggattacaaccatgctttcatggggggggggggggggcggcatggatggtggttgatcattatattctggtgtaaagatggcgtcctttcctcttgggtaatctgcatgtcggaaggaggatggttgtggataaggttcccaaaatttcctattgaattgttcaacgaccaattcttatggagattagggtctactcctggagtaatgcttaaaatcgacagagtgatgactatccaagcaaggggttgtttcacaagaatctgtgttgagattgatctattcaaacctttgcagcctaagattattgctagaggttacttattaaatctacaatatgaaggattgcatttgatctattttaattgtgggaggtatgggtacaaggatgcaaactctgtggagatgaaagccgatgttgtggatatccaatcccaacaaaagccgagggacgaaaaaactggtggagatatatggtggctaaggtggagatagttgacagggtggcgtgtgcatgataatggcgtaatgaataatattaatggtccagatttgaaaacgaaaatcaagtgaatgttttgagtaatgataatgccaatcatttcgggccttggtaattagtgcgtaggagtgtgaggaagaattagttaaaagttctctttaatggggttggccttgccaatcataccaagattgtagcacagggatgtgaggatcgcaacaacaaatcatttgggtcaaaattcattgctcttaatgaagcacgtgaggaaaggttggtctctagagttaagcgtaatgctaatgggcctagcactagtggcccaaagggtgttcagaaacagaataggggagttgttt

SEQ ID NO: 6217 - DNA, 1100 bp, Glycine max
  Soy_ogl_1633 Gm05:29715301..29716400 Cluster 27
aaaataaatttacaattctgtttgtaaaagttattttatatttttatcaaataagtcttaaaatttattttatatatttatcaaatgagtcatataagttatttttattttatattattgaaatttctagttaaagtagttaaagtttgtgcttccttcatgaaggcgggatcttaatagattgcgaagagtgcttcctttgagcatctgtgacaccatccgttctatggttcccccgctaattaccttttggaagcataaagatgttgggtccttctctttgggctcagcttataatgctattgcaagtattgataatacctcagttccccttttcaaatgcatttggaagtggaggggccttgagagagtgaagatccacctctggaaagtggctcatctggctttacttactaatcaaaataggcgcagaaagtagatgacagacaacgttaagcgctcggcgtgtaattttgatgtggagtctattattattcaggccattagggactgtagattcgcttcttaggtgtggactagtttagtgcccaatcagtatcaaaggaatttcttctctctggatttgcatttcgagcttctaaagaatttatcttcttctcatttttgtgatctaagggggggtggatgtcgtgcttggagtggtcttctaaaggaatgagcttatttttttcccaatacttgtaattttgctaatatgttgtcgtggagaataaggaagcaaatgtccgatattgctctggcggtgtagtccttgacccttcttcccaacacatctatgtcaaatgattttgtggcttctatttaccagaaacctcccccaaaaggtgagtttaaagtgaaccgtgacgcaacaatgagctcctctaatgaagcggctcgtggaagggtgttaagaggccattggggggtttgttattttcgccttttcagcgaaaattggtgcttcttccgttcacatggccgagctttaggctattgattttgcggtggacattgcccgttctaaggggtttgttgatctgatggcggagtttgattcattggtggccagtaaccttatccttaaatggtgcgtccca

SEQ ID NO: 6218 - DNA, 1300 bp, Glycine max
  Soy_ogl_2017 Gm06:19570901..19572200 Cluster 27
ataataaaattatatttttaaaaccagtagtcgcgatacacttaaaattataagtaatatacaaatagtaatcattactcttatctttttctatccttacatagttaaaaaaaagtaaatttttttataatgtattaaatgtattttgttactaatggttctttacatataaaatgataaataaaagttatatgtaatgacattttttaaataatattttgttaacaaaaaagtaacgattaatcaacaaatgtaatattcataatatatgaaaaaataaaataaaaattaaattatatgttttgatatcggtatcgagcctaatccatatgaccgaatgatcgaattgtaaagacaattatcatgggcttaaatatcctaataaattatatgtaatcaccttgtttatataaaatattaaacacattacttaattaaatcatgcacttaaaaagaatttaattatcttacttttaaattttttattaccttaatcatcaataaatacatgagtatatccaggttcagacttcagagcatcaacttcaattattcatcgagttgatgatgtttttcaaaatgccaggctccaaaaatttcattcaacaaaccaattggtagtgtgagtgtctgaggccacaaattcgtggggtgccccatgccctgtgtcgtgcagataacacagttggtgcatgtcaatgctctttccaaaaacgtcgaatacctcgcttcaagggatgccacaatcatgggaagcaggaacggcttcacccccatattcctcaacgtgaaaggctaaaaaggcttccagaaagaggtgcataagtgtttgaggaatgcacactacttcaaagaccgttagatgggaactaaggaacatcatctctttacaatgtgggtagcagtaactaaggaacatcgactcattacaatttaatgggaactccctaacgtgaaatggaatcatagcacacacatccactcattacaatgtagggcatataaaataatgaaaatacaaattttctttccatactatattgctcatatatatagttatagcattaaaaaaaaaaaccaatagcaggtatttttcatgagcacataagcaaataagaagggaagttcaccgaacgatgatagtgaccaatgtaagagtgacacagagttgcaagtcgcggcagagtcaagggcacgagagtaagaccagggtgcgagagatttgtggatgagagtgagtgcaagaggacaatgttgaaattatagaatatatatctataaatttaaagacagttttcaa

SEQ ID NO: 6219 - DNA, 1549 bp, Glycine max
  Soy_ogl_2020 Gm06:20186452..20188000 Cluster 27
atgggaaaagaaacaagaaaaactacaccgcaatcatatatgcgagggaaagaacaacctctagcatcagtagaggctaaatacaaaagctccaaagggggttaggcaaattaaagagaaacaaaaaaaattccctgatggcccaagttagccatgaaatcagcacactgttttgcctccctgagaacaagttgaatcttcatcttccaaccctcacaacacaattggctaataaataaaatgcaccatagagatgtagtgtttagacttagaatctttatcagcaatcatgtgaaccactatcaaagagtccaactaaaaactgatatccttcaacccaagatccttggccacttgaatgcctagtcttagagcccagagctccgcccaaagcaagttgcagatgcccaatttatgatgaaaggtagtaacgatattgtccatatgatcacacactatgccaccacaaacagccctccctgttgaggatttataggatccatttacattaattttgacaaatgatattggaggaggggtccaacaaatggccacctctttccttttggggttcatcatcgaaagaggaccaaaagtcattggaaataaccttggtcatagctaaaacctgatgacataaattatacaccatgtcagtcctattattgaacaccaaatcgttacgatcagtccacaggtgataagaagccactccaaaaaaatgtcgaccaatcatactcaacatttttaaattgatctatagaaagattaaaacggatccactcatgaagtccaaggctaaagaactttgcccagctatgtggaggaacaaaacgattcgagaagggagcaatatcttcacaatcgcaaatcatgtgcatgacggattcaggaccttggtgacatcgagggcaagtgtcaatatcagaccctggtaaccaattgcatttctaatgaaaagtattatctctctatttcatttaaatttaatgtaatcaaatcctaacaaacatctaactaaaaaatattatactttttttttgttttttttatgacgcagctatcttctactaaagtcaatcttattcaacacaggtaaaatcattggatgtgacaatccttgagaatatttaacattattatatataagagacttggacttaatttataccactcgttaagttagagcaattctatattagttgattcatacacttaattgtattttttttcttttttaagacatgtaatttaatcattatttaaccatgatcatatttttatttttatatattttttattttacttatatatggaaaaatttctagtaaattgattaacaacatgataaagtctcattttacgtgaagtctaggatggaccataatttttaacttttagattaatcttattatcatagtcatttcacaccaaatttttccaaagtaacccctcccaacaacccatctaaccatcattcgtcgttgttggaggcaatttccggtgacaatatttcattttttttttcttttctcgtctctccaccctc

SEQ ID NO: 6220 - DNA, 1000 bp, Glycine max
  Soy_ogl_2021 Gm06:20191801..20192800 Cluster 27
cttttgatttcatataacattaagcagataggccctaaacagtaaacacagtacctttcggtaatgtgcactggagacctacattccaaagacaccttttcgtccacaaaaaggacaccaaaagagacctttaccacacgccagagaaaatgacacatttaaagcaatttgcattcgtttgaggtttgtgcttctttaaaaagcttcactccaatataatggagtaatttcacttacttttccacataacgtgtcaaaccgacatcgatcttttcaaagatagagaggatgctgcagccttgaatctgatccacattaaaaaattcgctcaagagtgaaggcatgccaagagttcattctcgcctaattgaccatttgagtcatttttaaaatacattattgagatgggtcttttttatttttatcatcaatgggtcaactagtttcataaagccactagtcaaactaaccattttgacccagtcaatgatgaaaagagacacatgtcactaaattattttagaacaaattcatgattatattttgtttgtaagtatgatctaataatatgacaaaattatgtaatcataagatacctaaaatttacaataataacacaatactttatcttttttaatagtctagaaaagaaaagaaaaagagtcttccaaaaaaatagtttagaaaaagagcaactttgaaagattttcaagactaacctttcttttttagacccaaaagcattttcaatagcggaatcatcacctatttcatggccacagggaggaaccaatggcggtggttgtttggtgggaagagggggaaaatgagagctagggttcgaaagtgagagtggatttgaaatcttatttgagattttagattttagtagcatgaaggaaatttcattaaataaataaaattaaaaatatatttacatagtgtcggattagctgatgcatttaataaaaattatttcaaaaataaaaaaacatattat

SEQ ID NO: 6221 - DNA, 1170 bp, Glycine max
  Soy_ogl_2024 Gm06:20682331..20683500 Cluster 27
tatgacttttacttatatttaagtaaaaatcattataaatccttttcctattgatcaattttaatatattaattttaattatttattcttatatgtggtatccttataaagtttaagctaactctactcttggacgatcctagtggttctttaatagtgttttttgaatccttcaattatgtaaaaaattaatgataaatctcaacaatatattatcatctataaaggagtgatcattactttttcactttgatgcttttttttttcaagtatgttgtttaaaatttggatatgtactttaaataaatcaattgttggtttaaataaaaaaaattatttccaaaggaacgactttaatgagaggggatggaggatgtgtggatggaggtcaagcagaaggagcgtagctagggatctagggttagccatcaacagggcaaacctgacatctctagttggaggaaggggtttctgaaagaaggcaatggtcaaacgacgttcttcttcaccaattttcctgacgcatttcgtgtgaaggatatgtggaacgtcttctacaatatggtcatgtcacaaaggtttgcattcttgataggagggattgttgggggtaagcatttcagatttgcatggtttcaacatgcggaggatgccagatcgagtttacgggatcaaacttgacaacattttcattggcaggaaaaaaattcaagtcaattctccgaggcatggtcatggtgtggtggaagggaagaatatgagggaatctaatggtggtggagtgaaacaacctttgcaagtacaacgtggtaacactatacatgttgtaaatcctagggccacatctaacccttggtttacaaggagaaagaattagatcagtgtagggaggaagaatgaaaaggtttagttttcaagactgatgaagatgcaatccaatgtctgacaaaggcatatgtaggacgagtggcaaaatcgaggaaaacatatataacacaaccaaaattacacaccgagggtgttttcctcttggtgctaatttggttttattggatcttgcagacgagtatgatatagcgggtatggtggccacaaggaaggactgtgtagaggattggtttgatgagattgtagcttggaatccccatatattgttgataatgagcattt

SEQ ID NO: 6222 - DNA, 1035 bp, Glycine max
  Soy_ogl_2083 Gm06:45370901..45371935 Cluster 27
caaatgcaaaacgagaatgaaaaaaaaaaaaactaaacccatctaagtcctaacctggaaggttggagcagggaatctacgaacccagctccgcctccgccgccgccgcgggtggtgctggccttgctgctgctgctgctgaagcaggaccagagacgcggcgccatcgcctggatcgatcagcggtggcagcgtacgtgccaaaggagtaagggtggattgcgagatatatatgctaatgaattaacgagagggaatgcgaatgtttatgtagtattatgcaagcttttgcgaccgcgttgaagttttttcgcgtttgttgatactgtagacaaatatgatcgatatagtcccaattgtagtagccaacaggtttattaaaaccagcttggtattatgtttacgaaaaaagtaagcgatgaagagaaagagaaagtggtgtaatgataagaaagaaagttacgagtggggaatggagatggaaaggtggcgaagaacatgggtatgtaagaactaagaagaactacgcggggttttcaatatgcaatattttgtcttctttttgtacttgtttcttcggatttggaaatatgttttttaggatttttgttaattgttgtccttaattaattgattaaagaataaaaaaaaatatttattatgaacattataaaaaagttatacacaacacaatcttatatatttcaataaatatttttttaatttcttaactaataatctaaaataccgattaactttacctttttctagtattagacaatacaatattttaaaaaaattttgagatatgtttttgttaataaattaataatattgagaaatatcagttatactctcttctccatactaatatttctcattaatgatgaggaatgttactgtggaagagtatgctagtatttctgattaatgttatattcttattgtatttttttgtaatattaaaaaatataaaatacattgctttaaatttatttatttagtaaataaaaagaactgcgagacgagattata

SEQ ID NO: 6223 - DNA, 1565 bp, Glycine max
  Soy_ogl_2348 Gm07:16850472..16852036 Cluster 27
ccatgaacagtcagataaatgagcccacaaggaaaatgaattattagaattggaacataaaaaatgaaaatttttccttaaatttttctaattcacattctttttggtatgatagaaggaaaataagaaaagtagagaaaagtttgaaatatgaattgaaaaacaagggatagaaaagaaaaataaaacaattttatttttttagaaataaaccttctcttttttatttctcttattattttctctccatctaaataaaaggaaatacaatattatttgttttctttactcctgattttctttccttctaaccaaaaatatcataaacactcacaaaggaaaatggaaaatcataagatcccacaaaaagaattttgatgaacgaaaaaatagaataaaaaaatatataacccatgaaaaaataaaagcaatactaaaatgcagtgacaaacagaaatggtcctttggaagttaataatcattaaaaaccaagagacatgcttcttttttccattgattccacatttcccaaagctttctcagaaaccaacataaactagagaacaaaacattcacaaacatcacactcaacactctacagtacctaaccaaaatcagacatatcaatcacgcaaagttggctattttatgacaacccataattattcttctgaaaatcaatcaacaccaaaaagaagaacatatcagtacactaaagaaagcttatggatgataataaactaaactgagccaaagccaactatacaaatcaagctccaaaagcttttcataaaaagaagaagaaaaacttcattaaaattatatatatgctcctgtgaagaagaaaatcaaaaggctccaagtaccagactctttctctcttttctgcatcatgcaaaattgttttccattggtaggctactgtgaagaagaaaatcaaaaggcttcaagttgtacaaacttgtttgattcctgagcaacccaaactttccatttacacaacattcaacattgttttcataaataaaattaacacacacatgcatatggcagaatgtctatataacgaaaatagaatgacatacaaaccctaattacaaaaaaataatatcttcaattaaacaacattttgaccaatttatttaaaagcctaaaaaagggcatgccaaaatcattatgtaaatcgaatctactgcttgtaagaaccctagcaattgaagtgtgagagggaaatgataacaacaacaaccataggtacttactagctaaaacgacacgaccgcggcactacagcctattcagacactctcgaagacaatgtgcgtcaataaatgagctacgaactcatgccgtggactacgagctacaaaggtgagtagatgaggccgggaactacgaatgcaaggtatatagttagaacaaaggtgaggtattttcacgccggagcaccaaaggtattttcacgccgagaactaagaggtacaaagctgatcagtagagagatgagttcaatagctacggactggtgtgcaaattaggtttaaacctaattatgactaaatgca

SEQ ID NO: 6224 - DNA, 1300 bp, Glycine max
  Soy_ogl_2374 Gm07:24885401..24886700 Cluster 27
gcacacttttttcatccacattggataactctccattgaatgaataaatcttgcacaacaatacacctactagcgtttgttgccagtgaaataacacatttggcccagttcaaactaacatctacaagagttatttccacaagccagtgacaggctttgaaaccaacgacataattaaaatcttcaatcgtgctacttgaatagaatttccacacaagacaacttccatgaatttacagtattgactagggtagaatttcacctcttaaagaatctaactccaccacttcaaaattagtgcagcaatcatatgtccgcactgttatagactttggacatcttgccttaattaatctgtcaaataggatctgtcggtactcagtagggcactggtgtagaaaaaacgtatctcctcccttgctaagtttaatacagaactgaacatcacaatatccaaaaaacagagccccgtgtctttgttaaggacaaatctgttaactgtcaactcccatataacagttcggtagcaccagacgattttagatgtcactttaatgcactcaatcgaattagtgcatcattcagagaatgatgtaagagaacagagaactccatccaagcagaagatagtttatgtcctcttcttgagagaagcagaaaacacagttgattccataatcatagagctaaagtttgatgagatattgtatctagaaataagctaatttaacactgtgtagacttgaagtatcttctttccaaacccaaaggtctctcttgtctacaatgtttaatggggccatagcaattctgagttccgccacacaaacaaaggttgtcactgtttccattgccatggccaggtttcctgtctccactctcccattttttcgcaatcactgcatctttttctgctgccacttgaaagttgaaatagatgaggaaaaataatttttaatggtgtagttcctaatcattttccgtgccaaaacaggacttgccccacttctaacttttcatgctacaccttcagtgaaccacgaagaataggaaccagtccaacttgatgcagtcctagtgatccaagattgtgtattgaaagccatgttcaagtcaccatacagattaggtaaaagtttgtactataaattgcttgcttatccaccaagaacctccatttccatcttctcaaaagactcatgttaaatagttccaaattttttatgctcaatccaccccttgtctttcgtttgcataccctctttactaactaatgcatgggattttgagacagtcattt

SEQ ID NO: 6225 - DNA, 1100 bp, Glycine max
  Soy_ogl_2783 Gm08:21907801..21908900 Cluster 27
ttttttaataacaataagagaactcaattaataaacaaataatacaagttaagggacataattaaaaaaaacttaattaaaaattatcaaataattcagatacctatgaaataatttaacctagttttaaaccataaaatatggtatacatatagggaaataattaaaaaaattaattaaaaattatcaaataattagagaactatgaaataatttaacctagttttaaaaccataaaaaatactgtatacatatgataagacttaaggtggatcacaaaagagattcacagaactgaactatagataggttaaatagaagcatgttagggtggaagaaaggtgagtcaaataattggtttggttgggagaggtgggccacggcaatggttgcagaaaagagagaggaatgtctacccacacgcacgcatgaagtttatatcctttccttttgctttgtttttcatttatttctcactttaaaccaaagtttctgatacagtgatatgcaattttttttggtccaaaaagtttgtgatgtacattgagacatcaagtttgcacgagggcctctgttatgtttcgatgtgctttttctcttgcaagaaattgtgtactttttcttcttcagtgtccttctcgagtaacattcacattatattttatcttcataattgcctttggggagaacttattccatggacgaattttcttcctctaatagcacctcaacccattgcatttaatgatgagaaagagaaagaaactataatgtaaaataaataaaaaaacaattgtgaaaatcatttctttaatttagagtaagaaaagaaattattcaaggaaattgtaagaattttaactattgaatgtctcattctgtttttatagcttgaagatacagttgcacatgtgcacgcgtgaatgaccttgtatgtaaatatgcaattgaaggaccaatagtgggtcttacttagacttgagaaagagtcaacatatttgtataatcccttaaaccatttttggggtttatcactttttctccgtttatgtctaggattttgtggctcttctcctttggtcaattctcgtgtggttgtc

SEQ ID NO: 6226 - DNA, 1100 bp, Glycine max
  Soy_ogl_2815 Gm08:36473601..36474700 Cluster 27
tttagcccccacaaattgcaaacgtaatgtccgaaatccctctatcaccttcatccgcgttgttgagcatctccaccggaatgggtggcacccgcggcaggtacatcgcctacctccaccgctgaatctcacgaaatatctccacaacacagtaacaagaaattatgttttacgtttcgtttccctttgcgtttttgtgttcccctttcttctatctatccaaaaccaattccatacttattttttcactcttcggagaaatgagggtttaaacgctttagtctcaacaaatgccatttgggataaaatcctctacgcttctgttgctattcccaaccaaaaaatcgagattgtataataatataagtaccattgccattgagttagcacatgtccaaagttcctaccgtgtccaataaaatgttcttccccaaaagttcagttaagtgttgaatctttaatgtcattatgccggcttaattatgaatttggtttcaaattgccggcttaattatcaatttgatttcaaaattactgtaaaagatttaatttagtactttttttaaaaaaaatgcattaatttgattatgttcgtccaattaaactcacggtgttaaaattgtaaattgtgggagtttttgcttgtgaatagtaaaaactgtcactatatttatgtttttaaattaaaatttaataaaataaagataatttaaaaaatggagcatggaacatggctgaacatcacaatcgaaaatagcttaaaaatatgaggttgaggattcagcgcaacggtggaaacatggagcatggtggtgaaagagaaaattgtgaggttgaggattcaacgctacggtggaaacatggaacatggtggtggcttgcacttcacggttgctgctgctcctaacactcagttacctcaagcttgtctgttttattggtgataaaaatattttataaattgcacatttttatatccatgtgctaaattcaaactatattttcaacacccattatattccaagacacctagagagaaattttttttataaatattataaaatttatgatgtattaagaagaaagagataaaaaaaatt

SEQ ID NO: 6227 - DNA, 1000 bp, Glycine max
  Soy_ogl_3062 Gm09:16073001..16074000 Cluster 27
taatgccattcatgtgtatatcatgcagaatttatggattccacagggaacctgtaacgcaatagatgctacttccaggagactcatttggggaaatgctacatctcattgggtcaaatgggatactatcactcaatctagaaagaatggtgggcttggagtgaggcgagccagagacacgaatgttgccttgcttggtaaaaaagtgtggtcaatgatccatgatcatcatagtttaagggtgaatttgttggaatctaagtatttgagacatgattcggttctcaggcaaaaggattatacaaattgttcttatatttgggcttcaattaaaaaggtctcttcgattttgagttcaggatttcgcataagagttggccaaggaaatgtgtctatttggtatgatagatagtcttctaacagggttgtgggccctaagctggattatgttcatatccaggattctatgcttcaaattaaagaccttttcgacaatgtttattgcaactgcaatattttggctacccctatcccagccttgttgaagtatgagctggagagtgttttttgaatgatcaagttgttgatgttgtcatttggaatggctcttgtgatggagaattctcgtccaaatctgcctacaggggttaactaaagcccgatcccccacaactgctttagtgagaaacgaaacttgggtttggtgtctccaactaccaaaaaatataaagcttttcctctggcttcttgaccaccaaagtatccctacaaatctttttcgagctaaccaaaatttatctctagatttttcttgtttcaagtgtggagctgctattgaatccatatttcatgttctgcttcattaccccaatgctagcagaatttggaatatgcttcacttggatgtttccaagaatcataatgaagatttccaaacttggttgcagagacacatcaaggctgactatggcgctatttttgcagtcaggtgttggcagat

SEQ ID NO: 6228 - DNA, 1345 bp, Glycine max
  Soy_ogl_3081 Gm09:29575956..29577300 Cluster 27
tttggttcctcccttgatcacaaggctggagggaagaagaaaagaatttatgaaaaagaaaagaaatgggagatgcttggtatacgtgacatgcatgccaaatatggttgttccttttgttatttcttttggtaaaagtaatatatataccaatgttgaaattatgtatagagatggaaaaggtgagaatagagattttgtacaacatttgcgtatgtgacaatgccatattgttaattctacattgatatgagaatttgttagattgtgtgaaattttattgaattaacaatagccatgtattacgactaacattaatttctaactcagaaaaaaaaaactgatagcatatatactaaaagcgttactgtaagggcatacaacaaataaggaaccatgctgcatttggtgatggaaaggccaaagaaagatcaaattatgtatgggatataaaccatttgcaattgggcaagaaacccgaaggaattaatctcgatcaagctaaattaattagacgtctgttctaaaatataattattgtgtgtgtgaatttcaagctaaattgattagacaaaatttattagaagacaaccagggatcaggccgagctgactaaaatatgattagtttacaaaatactgatataacggatctaaaatataattggtgtctgatatgagggttttttttatttcagtgaaaaaaatattaattgttcaactaccaatatgttattagttcaaatagaattgaatttaattttttttaaagtgaaatctcatcttcaatttttcttgtgaaaaaaatataattgagatgaaagattttactaacataatcaactaaattttttagtagagattatttataaacgaaattggtggatatataccttccataaatatcatgatgaccccaaaaaaattaaaataaacacatcatgtttttgtttaaaaaagtcgtaatctttgaaaaattatgttttgatacctaagttgtgaggtccattgaatagcattcaacatggcccaagattctgcaactgcaggtttcaggataccactaaagaatgaggatgctgctttgagaaaattgttatgcattccatgtaaatagatcccaataccaaaagattgtgtatctttgaaaatcgcagcatctaaattacatttaatgtaaccgtttggaggtggagaccaaacattttgatgcgtatggggtcagagtttggagtatataggttggtcttttggcatgcgtctattctgcaaaaaaatgattagcaagagggatatcaagtgaggctggtacatttgattcattccagttcttgtcattacgctac

SEQ ID NO: 6229 - DNA, 1551 bp, Glycine max
  Soy_ogl_3420 Gm10:21419450..21421000 Cluster 27
ccgtaaaaatacactgcaggtaattcctttttatagccaaagctgattagcttccttataaccaacttatctctacttggtgttgttagcaacataactttccatatatctcgcctcaaattcttccaatattttcttttatatttccttttttgtaacttccttgctctactgccagtacatgattgttgttttgtaattgtttgggctgaccgagtcttccatatcttatacagaaaatcaaatgttttattgttgataactgttttccttcatcagtcggtcttttatttgaccaagtctactccttaactgccatattttcttgttctatttttttttcgtataaaattacaccggaataaaattgggtattcacagttgtccctctttactaatttttcatcaaataatctagataatgatttattaagattattatggtaagaaatgagtaaataagtgaatcaattttatctaggagcttctggactgaggatgcaagtgccagtgctggttcagagctttaatgctaatggctggtgaggtaccaggctatgatgatgagtgtcggtgacgtatccgagttgttatgttgagtgtcaatgatgtatctaggctgtgatgtagattgccagtgaggtatccgggcttaggatgcagatgcctgtgaagtttcgggctttgatactgattgtcgatgatgtatccaggctgtgacattgagtgctggtgaggtatctaggctcaggatgcagacgtcggtgaagtttcgggctttgatactgattgtcgattatgtatcctggttgtgacgttgagtgccggtgaggtatctaggctacgaggctgagggccgctgagatatccgggcttataatcggtgttgattctgatatctgggcttagaatgcaggtgtcggtgctgatttcgggctttgatgttgactatcaggctatgatgatgagtaccggtgatgtattcggactatgaacatggttgccggtgaggtatccaggctgtgaatgcaggtgccagtgaggtgttcgggatgttgtttcccaacttaagcgttggatgctggtgttggttccaggcttaaaataacataaaagtaaaatgtaccaagtaggtactgggcttaataacttcacgctctatgttagaaaaccctctcataggccaagaaaatttataggggacttaatgcaatgcaatgatatgatgcatgatgacatgagaacacgacaaattaatttgatgctgtaaaatcgtatgggacattaaaatctattggaccaaacttgtctcttttgcttcagtttcttaaaaagatttatgatccttattccatatgatagtgtcacacgtcccaagattcatggatgagagaactttaacttggcatttttgtcttaagtgagacatggggttaacagtatgttgctacaagcttttgtgagtaaatgcaacgtcaccttgctggatgcgctttgagaactcattgagcataccatgactttccaaagcttatcaaagtatttgtaatg

SEQ ID NO: 6230 - DNA, 1500 bp, Glycine max
  Soy_ogl_4026 Gm12:9259901..91100 Cluster 27
aatgcttggactttgctctgagttgtaagccttccataaaggttttcttcttcaacttcaagtcaatgtgacatgatcatggagagaatcagagaagtaattactaattagagtaaactgtatgcgtctcttaaatgggggagaacacaatttgcaatgccgtacatgcctgggaggctgtctctgagtctcaaaccacacgtttggtactatttcacaagagatcgttaaggtcaacgttgttccatctccttaattaggatctaattataattaaatcaagactcaattcatatctacaaaatattacctgtaatggtatggttcttaaataagattgaatttaaatataggttttgtttgtgttattaaaatatttgttaaaaaatttaaaaaatatatttattatacaaatcataagataacgtaaaaaaattatgtaaagtattatattgtgtatcttaataaaaatattttttaattaattttctaaatacaatagttaacattttcttttaaacataagtaagtgttaaataccataacaattaagtcaagtcatatagtattaaacattttttcaaaaaataatatattattaaatgagaccgtaaatggaggattttattaaggaatcagggtaaatatgaaaaagaatgttaaataacaagttgtaagtttaaatgttacttgaagtaataaatgaaaaaatgattagagattagagagatacgcttgttcattaaatacttttattttcatcaaataaatttataagataatcaaatgaataataagttagcaaggtttttattttacataataagtttataagttataattataattagcttactaacatatttctcctcacaaataagtggatgcatgttaataaatacgtatgaaattttagaaaaaaagtgagttagtagattataattacaattttttaaaaaatatattaaaagtataaattcttaatttttttccttttaaaaaattgagcaagtataatttgataaagtcatatatttatatataattgccgtcacccacgcaggcggcaagcgcgtgagaggtggcggcaacaagcgaaatcaaaatcacgcgaatccctcatgatggagcctccaccatgtgaatgatattttgccacgtaagcaaatcggaatctcgtgtgccacgtagacgacgcttcacattcacacaaaaatatctcaacgcccacaagaaaggaaccattgaaactgagggagatgtttgtttattatccattattaatgtatttacagaccacaaaaaaaaggtttcgtgttccctctggagcatacacctggcgttgcctgacaccacacacaccccattgctttgcaggtcctttcatcatggttactctacataccacactgccctagattttcgttttacaattatcaccctacattacaaaaccacgcctccttttgttttgtcctcttacaccaataatatctttta

SEQ ID NO: 6231 - DNA, 1166 bp, Glycine max
  Soy_ogl_4754 Gm14:34508335..34509500 Cluster 27
ttagaatatgaaaaaattgggactctaaaaacttaattttttttttaaaaaaatatcaatcgcattcgtatgcagtctttcaagccctgtacgctcgcgtttgttggccaaaggctatactaatgggggccaattttagatgataagaacattcttaaacatgtaatttgaggattggcctctaaattgcatcttatacttttagagagtaaaatgcacaaattttgacctttaatttcattataacatatggttgagattaataaacttcaattaaatttgatacatcagatttttgttttcttaaccaaatattgaattaaaataccgaaaaaaaaacaaattattgaattttgtaaaaaacaaaaataaagttattgaattaaaatagggaaaaaaaacaagttatttgccaagctctcacaacaccgacctggcaccctcccgccgactccatcttcatctacgtcgaacaggaatacgagttttgccattcatagacacttctgattcttgcaagaattgcaccgtattttgtaaatgaacccaagaattaatctatttttgcactttaaactaagctaaaagcaaaaaataagtcctctgacagtataagtgtcaaagtatgtaggttgtgaaacaatcatatatacttgctagacaccaaagcataaaacaactgctaccccttgtctaagtccaccgcttggaaacgataaagtgaataaaaaatgacgtgaattccaagcttgagaacatagcttcaaaacagtaacatctccacgcttcaaaacatcagcacgataagcgtagaaacttggtgacaacttttcgcataaaagccaaatacttttactgtttttttttctttttgctgtttgaatctgttgaaattttttctatcaacagtattcaaaacttactcatgtctactgcaaaaaatgtttctcgcaagctgtttgctcgaaaaccccaaaagactggccgaaaatgtgttgcaagctcttaatgaaatggatcacataaccgtaccaacacaacaaattcctctatcaacgcatcattttccacagccactggacaatgtcaatattgtcatcggtcatagggaaggatgcggacttcattgacgaagaaggcaacacgacgcttgggagttcccaccg

SEQ ID NO: 6232 - DNA, 1261 bp, Glycine max
  Soy_ogl_5074 Gm15:18798540..18799800 Cluster 27
caccgaattagatcatatacattaattaataaaccgcgcaaagcgcgggtcaacctctagttaatttaatttgtcttctctaaaatttcttaagttttaatttgtcttctctgaattttctttcttatttcgaacatatattaattcaagtttcatatcactataagctactaagcaataagggccatcgtacacgctacaccattcaagaaaaaagacaaaagagattctaggaagaaacaaaaatccctggttagatattattaataaacgaccacattgttcagctaacaagtattggattcacaccccaagcacatcactactactaaatgagtagacgggaatcaacaagtacaagtgatcatcttagtaaaagagaaaaaaacaaaaatgattttttgacgtcacaaatctatttgacacctaaaaagataaagatatataagagaaagaaatgtaagtatacatattagaaaaattaagagagaaaaattaggagtattaatgagctgtttagaattataaggtgttcacatattggcgctgagagtcagtgactcgtgtggcgtagtatttagcaatgaaatcagaggcttttctgtcaatgccaggctcagcaacccaatgtgctctgtcttcatcacttgcaaatatccttctcccattgccactaccttcccaatagtcatcatatctattcccacttgagaaacaggctcccattgtctcttttcttctaatgatatgcaagtttcactctcaacactctcaaacaaacaactcctctagtttctaatgttagttttgagtgctttgattacacatgcagttgtttgtatttatagagtggcaagtcacatggttatattataccacaacacccaaccttttaatctacgtacgtgcaaaaagtaggataaggattctctataatcactgataactgattaaaatggttatattatatgattgtaaaacacgaaggaagcataaacgttctcgtcctctacttttgaattgtctcgcaatagttctcacctagctacccacgtgacacactgttcaactatgcttttgttagttaccattactatttttttttcctggatgccttctttttcttatcgaaataaggcttacataaatagaataatgcagaataaaccaataatccaaattaacccaaactaattttattggttcaatttggattatcacactaatcaatagttcaattttgtgaacacccttggtcgat

SEQ ID NO: 6233 - DNA, 1400 bp, Glycine max
  Soy_ogl_5092 Gm15:33339501..33340900 Cluster 27
atagtgttggggggccgagggatattgaccctatacacatcgtcttaaattttttttaaaagataggtttctcctaagggctactaaagagagtatggacttattatatgggtttcctaaccgctagactaatagtccttgtaattgtgaagggtacgagttataagccctgtcaacatttgatcaatgtgttgttaaggatataaaaaaatagcattgttcactactatgtttaaatcctcctagattatcaaattaaagtatcggttggtatatctaagagtttttattgatatatttcatttttactgctaagaacttatatgtttgatttcatatattagtgttttcacgttgattgttttatgcagagcggacaacaaagaagagcatggcaccctcaaaccatgacatggctcgactagtcgctgagaagaaaaaggttgatcaagtggttaacgttgttgttgttaatacaattgcggcaagaaatgtgattgatgctggcgaaaaatcaataactctgactgtcaagctgcttaacattgttaatgtagaatccctacctcgaggaagagggaacgaacgaaaggcgacagacaaatctacattgaggtggactctaaagatagcctcctagcaggatcgacaaggactgatgggcaattgcctatagaagaaataggggacaacgataatcccatggacttcgggaaccctcagaatgaaggtagttcattatgggacgtggttttccctcactcagtttataaccatacacacaacatgccaaaagcttaccacacggatatggaaaagttgagcttcgtcagcagtgtgaaggatgcacatgtggagataactcgacttcacgttattctttgtgtggtcgaagaccaatggtgggacatgatgaaagagaagaagactcttgagaaggagaagttgtgccttgttgccaaggctaagaaattaagaaagcaagtgtcagatactgaggcaggtctggtcactttggatcaagccaaagtcaatcttgaaaaagataaggaagttttggctaagaaggagaaagagataatggatagcttggaaaattttaaaaatgagaagaggaatttgcaagagagagtgaccaccctagaggtgcaattgacctaggcatctgatgagctagaaaaggtgaaaacaaatctaaatatggcaaacattgaaacaaccttgtaattcgttgaagtattcaatgtggcgatggagcaagtgaaagttgtttctcctaatgtgaattttgatgtagtcatccccttcaaattagtggtcaattgcaaaattattgaagcggttgactaaggcgtgttgggtagtttgggtttggagttaaagttgggtttgaatttgtt

SEQ ID NO: 6234 - DNA, 1000 bp, Glycine max
  Soy_ogl_5096 Gm15:39631501..39632500 Cluster 27
atgcaagatcacttttagcatcatggagggatgtttgtgggggcgtgaagcaagaaggatctggtggggggtttggggtattacattgtggtcaatttggttgtttaggaatggaatcgtgtataaggatgttcccagagatataaataatgtggtggagcttatccaaggaagatcgtggcacatgttccaaggcaatgcaaagtcaaaagatccccttggtctcattttgggattggtcctctacgttgagggtggtgatcaccagcccaataattgggggtagttattaacatgtcccatccataatgtgctagttgttgtatcgttgaagggctctggtaacagctatcaattttatctatatgctttcatgttgaaatgtagagtataagaggaggcccttagtggatttgttgggccacttaagatgagatgttcttagtcgcttaggatgagatgtgttttatgtatttatctttgatcagtgtactatggttaagacactccttgttcctgttttaatatatttcttttgctaggataataaaataaagattatttactcacataatattatagctgcaagaaaaactaataaaaaaaactgtaaggaaaaatattttgtcagtaaatacgttaatatacattcgtaaaacggcatatattaactgatcatcacttcaatgcttatctgataattcctagcatagtatataattaacatttaattgagaatttcaaaatttaagaacataattcaacaagttctttgtcgacagttgtatatcaatcaaggtattatgtatactttaatttattgttcaagaatatagacatttaatttctttaacaattaatgacatacgacaataactatattctattatttttaattattttcattcctcaaatttgacataacctaaattttcaaataaataaatagccattcacttataattcatagaactactaatatattttaatacacttcttc

SEQ ID NO: 6235 - DNA, 1300 bp, Glycine max
  Soy_ogl_5101 Gm15:40618701..40620000 Cluster 27
aactaaccccttgctaatccatcttaaattctttgcaaattatccctcgttattccctcatacatataccatctcattctctttgaaaatcctccatctagcatcgctattcccttgttaatttcttgcgaatatcccttgccattctctcattattccccaatgaatcatcccatccccagtccctcacaaatatcccccttgctattccctccaaattcactcgcagattgcatcacttatcaaattatttccctcgtgattaccttgctattttgtcgctaaaaagtttagactaaattgtatccaaatttatacaaaattaaaacaaatgtttcatttattatagtacactctgtatttgaaattaacacataatataactgaatttagataatgaaggaaaaaataacaaaaacattatcaacccataaataattaaaaaaatgcaataaactttgaattcttaacgcatgatataactaaatcaatcataaagccatacaaagataaacttaaaaacataatttaacccaaagtgcaacattcaaacataaagtaagtgtatgacaattgaatttgtcataatttctacaaaggatcataagaaaaacttgatttaaccaaaagtaccaccaaataaaaaaaatagttttttgttgtaaggtaggcaatatttccgtccgaaagaactccatttgcatttgcatttgtgcatgcatctcttcctttccgacctcatctctccttaaatgttgccttcatctcttcctaagcattcatttgcgcctccatttgcaactataactgtatttgcaattgggtttgcatctgctcccttatttgagacatttgctcttacatttgagacatttgtgtaacaatagtagcaacgtatgtggaaatgaaacaatgaaaacaaatgcatcactcaacaaagtatgttttatttgcatgtcaaaatgcacatttaaagcctcaatttaaaagacacatattacctatacatgtagaaatataaaaaaatgattttattttctaatttttgtttagtgaatttatcactcaccaaagtatccatttaaaataataatgataacaaacttaatgaataaatactattatttcaataaacactatcaaatatttggcattcaactttgtctaatcagcgacgaaacaggaagccaagaatttcttcgctagttggtcactaatttgcaagggatcatagatagaatatttccctccctaatgtcctcattaaaatgagaatttcttatagtggtgcctgcatggc

SEQ ID NO: 6236 - DNA, 1277 bp, Glycine max
  Soy_ogl_5103 Gm15:41092301..41093577 Cluster 27
aatggtgcatacaactcacaactacaaagaaatacacatgaatcaaatgtatgctttggaaccaatcacatttggaaatcattgctggactggaccgccatatacaaaaatgcatgtattcacttcttatgtcactcttatggaaacaatagcatgtttatcaagtgaatgctttctcatgattaaatttttttatttaagagatggttttgacttttgacaacattgattgtgtgctagggcctaggggaaataagatactgatatttattaaatatctatggcatagaagagagaggtttacctttatattaaagccagcttttgcattagcttcaataaacataacatttagctctcgagactttgcttccccttcctctgtagagacttgcctgaagtgttaaatgtatacaacattattcataatgaaaagtcaatgcaaaaacaaccttgttcctataaccatattaggacaatattttaattatacaaataataggcaaaagcacagacaatgcacaactctgcaactgaaatttagttacaattacgaagaatggaggcagcatggatcaaactcctgaccacttattcatagtagctataataccatatcaaggaccaagtcaacctggtacttaagttgttcccaaatgacctactctggtataaagttctttggccttttccaaattagtagcttctagcttcggatttctcttctcgttacatattataacaatatattatgtattaagtcttttagaaaggaacaaacatcacgtcttgacacatttaccaaatttacaaatcaacttatgaattaatgaccatgtatttggtgaaaaaattatgggctatgaatctaaattgaccaaccgttattccaagaataaggatttaacttgagctttggttgtctgctatcctgaggaaagaagggtcctaactcctctgcttctccataaccaattgaggaacaaccagggcctgaaaacattcatgcattttcttcatgttaattgcaataatgtacattagagtgataatcaattatcaattttttatttctaattgcttttgtatttctttcaatttactagtatgttataaaacatgtattggacgtactagggggtttaaaattattagcaccgggaaaatgtattcgtctagcatcatcatatgcctctctaaaattattaaacttaagttttagtcccaccgaaaatatatacttttactagaaggtataaaaactaaatatatatata

SEQ ID NO: 6237 - DNA, 1700 bp, Glycine max
  Soy_ogl_5714 Gm17:31561801..31563500 Cluster 27
ctatattattgaatgtaccaaaagaaatgagaacaaacaaaatggagtactaaagccaatacccattgaattttttttaataaaacccataacaaggtcttcctagcctatcttggccaaaatgaaaactaagtaaacctggtaaggaatccctccaagcaaatcaatttagagaaaaaccataatttgccaatgcattcgcagaacaattcccctcatgaaagacatgagatatctaaaaatgcatagattttgtgcaagaaatagcatttttcatctgttgtgaaaggctccaaggtaccaaagaaggaatcttgaaaacttctaccaccaaagttgagtttgtctccaaccaaaagagacaaccattgcttatccctggctatctcaatggccatcaaagctacaaaaatcttagcattgaacgagaaagaattgcccaaatgaacaacaaaggctcctaagaaatctctagagttatattgaaaaatagttccactagcaactgctccaggtgaaacctcttgctgcaccaccagagttaaccttaatccgaccaatctgaggagtgcaccaaataacaggtttgatgacatgagcctttctagcattttcatcaatcttaaaaagcttgagaataaagaactcctctatactagaaaccatagttagtttagagaaactttatgtcaaggctagagatgccataatgttggattttaacgaggaaatggggatattgacattctcaaaatggatattattcctatgaatccaaataaaccaagcaacatttatgatcccgacaaccacaactttcagaaacttgcttactaaaaccacaattgaatacatataagagagcaaccggagaagaaagatctagacccactttataaatagaactaagtcattgccaaagctcaaccacaaaaggtcatgacaaaaaaaggtaggatgtatcttcaacattagcaccaaaatgcgaacagactaaaaccataacacaacctctcctacgcaagtgttcatttgtaggaactaggaagcttatcatgaatcaaacgccaaaaaatgaaagatcaagaaggaggaatagattgtttccaaatcaagcccgcccaagtaactagagattggagatgctgaaaaaaaattaaaagcgcccttaaaagtcaaagttcatgtgttggaagggcatcaaataagataatcacacttaggttcaagaggcataataatatttctgatctccctacaaagaataggatatttaacttccatagcaggcaagatattccactgcccatgcaagagaaagtcacaagcacatgcagaaaaaggaagttttaagatgggtcggattaatattggccatatcagagacaataccatctaaccctatcccaccaaaaggaaattgcaacaccaccaccaagcttccatttagtattttcctacaaatcaaaccagcaatgcctgatcccaggccaaattgaagatttaacatatgatgtagaaggatgtttgtttttcagaaacctatcacaagccattacaggtcattgtccatcagaggttaacaaagaccaacataaacgaagcacagatgccttgtcaatatttattaagagggcaaatgcctaggaccccaacatcaaggctagaacaaaccttcctccaagaaactgtaaccaact

SEQ ID NO: 6238 - DNA, 1263 bp, Glycine max
  Soy_ogl_6018 Gm18:11623798..116220 Cluster 27
gtttaattaccattttagcccctgaattttggatatatgcttttttagttcttgaaatttaaaaatatttttgttagtccttgaattttgaaaaatgcattttttagttcctaatatagtaaattgacattttgtaacggtttttaatcattttaaattaatttttattttttagctacttgaatttgcatttaaaaactgccacaattctaaaacacctgtcataaagtgcttaaaaacagtcacaaaatgttaatttattatatcaaaagtaaaaaaaatatttttaaattttaggagctaaaaaaaatatattcccaaattcaagcactaaaacaataattaagcctatatatttttaaggccaaaattttgtgcagctctagaagccaattgtagaggaactgtcacatatggagctaaacaaagagtgttatgctagcacaaaataaataaaatactttatcatcagttaagaaaacctctccaaatagttgatggaaaatacgatcgagtaatgtctagccacaattttcttctcttcaagctgggcaacaattgaagtgtgtttcctttggagggggacctcaagccaatggaggatgtgaacatatacaaaataaccaagagaattattatataaattaagtattttatcatatattaaaagtctttactcttttcatgtatatattagaatatctttagttgaagattttgagctgagatattgagttgaatatctgatctagttcagatttttcactaaagagagacctcggatctctagcatggagggtgagactttttacaagacctcttaagattctcaccattctaaacaaaaaaagagaagtttttactgtctctatctctctccctaattaatagattgtggagagaaacaacaaaaatgaaaaagaggggaagaattgaagaggagaacaaactaaaaaatccataggggagtgtgatgcgccgtagaggtgagtgtggtggcctcgcatgccgcagggggggacttgccccagtggggcaggattaatttttcagcttatttacaatagattgtgtatttatttttttaaaaaaaattcaaatattttaaaataaagtttacactccaactctgaattttataaattgagctcatagatgatcatattttgcacaccaattctccttatcatcctttatttcttaatctcttatttgtaatttcaatctcttactttagttttattcttaatgaattcaaattag

SEQ ID NO: 6239 - DNA, 1400 bp, Glycine max
  Soy_ogl_6026 Gm18:12085101..12086500 Cluster 27
cttgaaaaatatctttggtcaagagagtggcacatactccagctgtttggagatctgtgcatgaatttgactttggcaatgaaccatcatttcgaagcaaaggcatgattcaactatcttgtgtctcttaactatccctgttgcattgatatgcatgaggatttgcatttcgtaacctcactaataatgcaaatctcttaattttttttgttagttccaaaagcatcaacaagcagtactgttgatgacataaagcaagtctgcttaaaaggaccaatgagtacgaggtagctttgtatgtattttctcttagtctgaatactacattaatcccaaatagctttcgagtcatatattttttaatcatatatttctttaacattagcatgcaaataacttgctgagaaaatattcacacagtgaaaatttaatgtagattggtgcttcctgcaataccaattatgtctagaagcagggaaaatttaatatttatgtgataaatataagatgtaaattggtccttgtgtccatatatgatatgagctcttctataaaatccattaagaggtcaactttatccattaaagccttgaaaatcatggcttttatctccgattattagcactaaataactgcaaaatccttgcattgccatatagaacaatgtgttcattgcgtttgaaaaccttgaaaatgctccaagcttgcaaaacaaacccctagatattcatcaaacttttgaaaatctgtactacaaatatatctagcggcagaacagaattctgatgccactaaccatgaaattaaagaattgtataatgcaaactctaaaggactgacatctccaaaagcttaagctattaagtaaaatggacaacttaccttctgtgatttaatcttgcaagagcccaaaggcttgaagtgtctggacaacgtatgtgcccaccttaccttctattgaaatttaacttgtgtttggatgaatggagttggcaaggatcaaaatccttgctacttggtcaaacatgttctgataccgtctcatgtcaaggaaaatttctaccatgaatggtttttatatctaaaaataaagacaatgtcctttgtgttaaccctgaaaattttttattgcatggtcctagaagatgtgccaatttgagtctttatgaaatgaattttgtttaaatctttttaatgatgtggttcttggtgttttaagttttttatttcttgaataatttattgttttgaatttctcaggtttcatcacatatttcttcaaaagatggacatcatgattgtgaagtatggatttatctattttcatgtctttagtacattatatggcatatttgcggttcaacattctcatcagtcatgcattgagtgacacagtggag

SEQ ID NO: 6240 - DNA, 1100 bp, Glycine max
  Soy_ogl_6047 Gm18:15731901..15733000 Cluster 27
gtaaaaataagataactaataaatgatgtgaagaggtaataaaataaaacaatatatatcatgaattatgataaaaaatgaagagggcaaaataaaaataagtatttttttgtgtgtaatatccttattcaattagtagtaccgaaatattacttcttgtcttaatagatatagatatgttgcatttttcataactacaaatataaatgctaagaatatcaaaactaaattctaaatttacacacgcacgtattaaagagaaaataataatgtgttatgtacagttttgtaaattttttatattattttttttttaaaaaaaaaaaggaaagggcaaaagcccctacaaagatttgttaaaaattccttggaaaagagatattagctacatcaacttaagcatgcaaataaataaaatttggattaaaaccaaagatgtttccatctcttttaattaagagtcagttcgtacttagcaagcgcatctgccacataattcgtctctcagaaaatacacatccaagtaaacaaacattcacaaactatgaaatcttttatcaacttcaacaactgaaagcaactgagttagctgacaacatccttcaatcatgtgaattggaattatattcaacacttaactttgaaaaacctcttgaccatgcaattttaacaccctttgcaatggcccaaagcttagcctacgagatagaacagttgtctgagttataagcatgagagaaaatgattgtcccattgtgatcgcaaagaccccccctcgcggaagctacagtaccattcgttgaaacaactccatctataaattaatctgcactcgaaggcccaagaaataaggccagtagtcgctgaatgactcttatgattatggagaggcaactacatattccaagactgttgaatattgattattattctacgaatacggctcaccaaactatcaacagttgatgagaaagacgagaaacctacatcatttatgttttgcacaaagcataagcaaccactccaagcaccacgtcccaatcttgcactcctagacaagatggaagtagaatatttccatgaaaccaaacacaaagttc

SEQ ID NO: 6241 - DNA, 1200 bp, Glycine max
  Soy_ogl_6058 Gm18:18005701..18006900 Cluster 27
atattagaaataagggcaacgactttgttgcttttaatgctcaactctactgcctccactttggtgacgggtttgaatggcaatttccataggttgcctactatggctttccaagatgaatttgtttctaacacaccaaatcttgtctatagctacaacaaaggtgcatgcccacgttgagccgtagacagagatatccgtattaaggtttgtcaaaagccaatcctttgtatcttgcaaaaagaagttctaatgcaaggaggctggaagcagaatgtaccaaacaactctggcaactccgcagaaatgaagaatatggtcaacacttttagtatcatttccacatagatggcaagatttatccagcgttaaatgtcttaagaaccaggattcattagttaaaagcccattgattgcaactttccaaagcaaggctctaattctttctgggccactctatccccagatagcaagataaagagaatcttcaataaaagaaccatgttccgtcaggttgttgtactttgatgccactaaaaaggacccatcagaagatcctgaccatgacactggagtttggacctctagaaatcttaggagggggatagcacgaataacatcaatagtctgcgagtttaggaattgagctagcaacggtaagttctagttcccatgattatcaacatactcacccacattttaattcctatgctccataggtctagtggaaaattgctttgtccaaattaaagcctaccttgagaaggaacccaaacgctctcccagaaactctaacattgttcccatccccaatatttcagcaaaggttcttctgtacctcaggccaggttttacaaaggccccaccagaaattagtctcaaacctattacaatcaatatctgggatcaaagattctccacagtgatacttttctctgattattctgacccacaacgcatcctattcgaacataagctccacccgctcttcatcaagaaggctaaattgaaatttatggattctttaaagcccaagcctcccttgcccttgggcttacatagctccttccaagccactctatgaatctttcgatgattatctgaatctccccacacaaagcttatgcactttttgtccatttctttgcacaccgatttaggaaggacaacagattgcattgcataatttggcagggcctg

SEQ ID NO: 6242 - DNA, 1200 bp, Glycine max
  Soy_ogl_6065 Gm18:18584401..18585600 Cluster 27
ttattaaagtctcttctttttcgagtctagtttgatcaagatgggtgagtgataaaacttggatgcaacaatactattaataagcttgaaattagggaacaaatctacccaatctgcagtagccacaccacggtcaagttttccctctttttagcatcatattttcctctgcgttttgcccatgtgtattagtagccctccattgggaggtcatgcgaattgcaatccgccaaagcctctctaaagccatttagaagccaattagggtgatcaataaaaccaattttttcatcactggagagaaggtcgttgaagttaccgaagacacacaatgggagagaagtatcatttgccaaatatcggagaagattccatgaatctttacttcttcgacactcaagatacccatagaagcccgtgagcctccatgaagggttgcttgagaaattgagaagttgacagtcaaaagggtgtttccaaaacatgaccaaacctccacttctgccattagtatccacagagagacaagaatcaaagccaagaagaatttttattttgtcaataggtctcgcatgaactaaagtttcacataaaagcacatccacatgataggactagacaagatcacggacagcaggaactgcaatcaggttgaccaaaccccaacagttccaactgaggaaactcattggccctggtgggcctagtttccagggcccacaattaaaaaaaagggtttgggtttgtggtatgggaataggtgtgggtaaaggtttccatcatttggttgtctatggcagatgaatggtagtgcacgtcaatgtgattagatactgaattacgtagtctgcgtttcttgtctgctatgatgagctcgtgattaccttcatcattagcattcattgctgaattattgggaggaaatgaggacattgatggctgtttattggaactaatttctgacgattctgtttggccattgattggtgcattcaagtttgaatttctgaatatagaagctataaatttctaattgtcacggtctgccttattattggaattgattgtcttgtcggtgcatttaatatcatcattttcttgtctcccccattgtttgaaaccgccatgagtttgcatctccagcatcctggaggtatcaagatcctcttgcaccctaattttggactccatgcacgtttt

SEQ ID NO: 6243 - DNA, 1500 bp, Glycine max
  Soy_ogl_6080 Gm18:23123401..23124900 Cluster 27
caatattttgccattcgttccccttccctcaaaagctttcactctcgaagccttttgtgttgaactccaccgcgtctttgtcattgttagtgtcgcctgagttgtcatcactattgccgtcattagtgttgcctgagatgtcatcaccatcgccgtcgtcagtccactgcagccctatccgtgatggcgattcattttgcaggcgagtaaattcatttttccccttttgtagttatcttggagcaccttaaatctctcaaaattgtatgtattcttttttcacattacaaaactaattatttttatttttgtttctctgcaaacaccatccatattgatctcatccccaacagaggggacttcaggtgaggaagcctttttcgtcctcgatttcaggtgatgatcttttatggctcaatcactctatggagttacacttttaatttcttatgcaggtagaagctgatgtcccagtagaaagttttgaattgtcacctgttgaccagatttttgttcgaataagaccaaagtacatttttaattaagctttcaaaaactgcatcaatgctggtaagatgcccctttgagtatcaatttgtatcacttgaaatatgggttctcgtaagccactagatcacaactttcatatagttactagtattctttttggcttggtccttttttatttagagctcattcatttatatattaattagttgtgtgcattttgtgaagttttattggcccttttatttggcttgttaagttgttatgcattacagatgcatgtgaatctaatctttttaaaccattgtttctttctaaatatgtacttttgattgtgagtacagtcatcagctactcataattcattggtggctctggatgagcttgggagaaggactacagcttcttatgggcaagaatatcttgtgcggaaggtgcagtattgcggattgttttgtactcactatcatcgattagctgttgattatctcaaagatccaaaggtattactagttttttatctagtgtaatcatcagtggtaaattttcagtctaatgcttgcaagaaacattttaatcttggttttgttagtttacttgattgcccataatattgctagtcatgacatatttagacatgatatcctatagaaagtttacattatagtgtagtaattcgttccatcttctgcttggttttagtttcaaaacttaaattacatttctaaattagctttttgtgcttgtaaagttctatctctgccacatggcatgccaagttggtggtggaattgcaggtttatatgaagtcacctttctttacaggcttacccctggtgcttggcccaagagctatagtgttaatgttgctcaaatggttggtatttttttattgttttcaaatatgacaaacatggattatgcttctctatagtaaaggtggtaaagcaccaaattataactgcacttaaaattttaataacctcatagtta

SEQ ID NO: 6244 - DNA, 1092 bp, Glycine max
  Soy_ogl_6082 Gm18:23703497..23704588 Cluster 27
gatagattttgcattaaaacgtttataacgtaagaaaaattaatttttaatctttgcatgttgatctctataatcttgtggacgtggtaatggaaggattagtattgttgtgacttgtgacagcttgctataacgtgtgaaagactgaaagtagtggtaattgtcttcggctatttccgagagagtacgtatgcaagaaaggatatttacaatcgtgggagaaagaaggcaacgaaactttgccaattttgggttgtgaaaagtttcattattttatagttgaaagcatttgtaaagttatgattgaatttggattgaaatcacaatgggtttctctaggatctttgcagattttcctttttactttattttatgcattctccatgagcatttttaagaattaagaaattcctataaaactgataaagatcaaatgcacgttatttatttttgtaaagttatgattgaatttggattgttaagtcacaatgggttttatggtctttgcagattttcctttttcgctctattttatgcattcttcgtgagcattttaaagaaattggaaattactataaaattgataaagatcaaatgcacatttaaatttattttcagggtgatctggatccatacttctccacccaacatgtaataaataatcaagattttcgggcacaggaggggttgataaagctgcttttagcttctttctttaaaaaaaaatgtagaaataatttatgggaagttggagagattctggtcccttatgtgattatctttttgaatgattacactggcggcgctcagaaattgttcctcccactttggtttcgtaggtactccttttcactgatcgttttccttttcagttaattttgattatgcatgtgttcatacattttgtttatgttgtcgagggtggaaaccaaggatttaaagatcacatggacttgtctgattatataggggttggtttaagacggtgagagattaggtcctgttggaagctagaaagtggctaatataggttgttcggagttgtactcttgagtcagagaaaaggatgaacggaagctgaaatagaagggt

SEQ ID NO: 6245 - DNA, 1336 bp, Glycine max
  Soy_ogl_6100 Gm18:48103401..48104736 Cluster 27
ttcaatcagaagagaatcccagtgtgggtgactctagacatgacaacaaggttacatattcaactgcaagctaagttggcctactgtatcatttcccattcttggtccaaaccctgggaaggttttgttaaagccaatttggatgcttctattgtttcaggtaaaggtactagtcttggtataatctttcacaatcattctggtgaagtcctggtaattgctactaattaagttcctcccctcaatttgatgtccacattgcccaggctatacctttagagggcgattgagacttcttgctatcttcagtttcaccctgtgcactttgagtcagactgccaacgtttggtcacatcctagagattggctcccttcttccaagtcctattttagtgggattctgcatgattgtgctgatctgtttggaagtaattttgcgtcttttttttttacctttgttaatagactagctaatctcacagtcatagcagataagttacccaagcttgcttttttgtcttttgatttagaagttccctccttagatggtaaatttggttgactctgatgtattacttaagggctattttcctcttaatagacaagtcccttgtttcgaaaaaaaaaaagaggtaaagaaagtcagatattacgatgtgtaatactattacccaatagaaaacactatacccttaaggaagtatatatagcggaagatttggtttaagtaataaataaaagattatatagtttaattagccctttgattgttataattgcaacaatttttttcagtctatgtagttttaaatatttcattttggtctttatagttataatttttttttgaactcttttatctttatcatttaaaatagtttaacatcgttatattttgataatttaaaatagctacaaaatggaatttgtccatgtaaaatcggtaaaaagattttggtgatttttatctaccataaattaaaacattaaattttttttcctaatttttttcttcttccgtagcgggtaaggatttttattccttgcacattccagtgatttcacacaccctctgacatcctcgatctcccaatggcgacttcttggcattcccgtgtgccatgctagcgaagatcacaacctccttcgacgacctaaacgtgcatgctacatcactggtgttgttcgtggtgagagatgttgcggcccttgcaagaggcaatgatgttgctctagtgggggaagcgcttcaagcacaatcggcgtgggtccgttccaatgccaacaatgctcttgactcgttcatgaaattcgttgtgtgtgactctaccctagc

SEQ ID NO: 6246 - DNA, 1000 bp, Glycine max
  Soy_ogl_6376 Gm19:26037501..26038500 Cluster 27
gtgaaaccagaggtcaataacaagactgacttgcccattccagacaatgccctcttctgtggtgcccttagcaaattgcagaagtatgctacaaatccttgtctcctaactaaaccagcattaacttcaaaattatgtatggttctaaattttgaggtcaattatgtatggttcttttctttctggcctcaaatggaaggaagtagaatccaagcatgaatagaatttttaataagaagaatatagaaggcaagggatcgatagagggataatacaaatattttttgttgtacacttgtcattttcttcataaagtgatgaaaatctgattggtaagagttcaagaaattcttcggtatatatttttcccttatagaaacagtcatcataggctgcttataatatttcttagctttatatatatgatgacgcatataatcttgtattctaattagagtagagacatgaaggtgtaaaaaaaggaaattcattttttcttttcctaaacagtatgctattgattccaatcacaaatcatttatccttccatccattggtgcatggttaaataaaatttcatagcatctttattttgtgttaacccacgagcagaccttttctgactcactcatatacatattgtcaagaacaaaaccagcatctaacgaatcagttagtgagcttccagcactcaaactcaaaaagcagattgtttttgcaagaacctaacatccaggccttgtaatacttaaaaaattgatgagggcaatgagtgttaagtaatagacgattctaggattgacagtcttattgtaagataataggcattatctacgtcttcttaaaagtgtagacgaggcactcataaatggtgacattgacatcgttgtccactcaatgaaagattttgctacttacttacctgataaagcacttctaccatgcaaccttccacgtgagcatgtaagagatgcatttatatttttgagtaaggttttca

SEQ ID NO: 6247 - DNA, 1232 bp, Glycine max
  Soy_ogl_6381 Gm19:30639969..30641200 Cluster 27
gcaactagatgaagcaactagaactcacctgacatgtagaagatgtaaacagatgaattccttttcataagcaaataccctcttgagatgttagcctttaacaattccttcttgtcaacaccatacattttagtggttaacggagctgggtggttcttggacttgtcaaatggagttgcaagctcttctctaattatcttctctaattatctttggtgctggttggagtgagagataactacagtgttaaaagggtcacagcaaagaatatcattaatccttgaagattaattattagaacttggaattttcaaaggtcaacaatgacatttctgacaataaagttttcatgtggtgtttactaatttggaagtcaaatgagatttgtgttttactttattgtgtagtctaatccaaggaacttaagggagtaagattaactattttcttaaactagattgggttgaggaaacagtaaacaatagaagtacaaattgcaaaaaatttgcttgaactttgatatgcttgcaatagacccaatggtctagttggaggcccaatgtcataatagcaacgcatgctatatttagtgcaataaaaaaatttcaacgtaccacaaaataaaacactattaattttgcaaaacacatttgactttttttttccttaatttgagcaatactacctccatacgttcagcaaagtccagtgccttaaaaattatttctaggaccaacaatgagagtataagtggtgaagtcagctgcgtgtatggaagagagagaacaagaatatcagtgggcctatgcatatatgtgaactgagggttggacagtgatgggggcacacacatttccaagtgataagatcctaaatatactgaatgatcactatgatgaataataaagatatatgctataagaaaatacttgtccattatatgtctgtcttcatgtatatccatgttcccaagccactttccattctcaataatctacatagtttctgaaatgcaaaccaactcgaaaacaatatccactgctaaatacaaacacacacacattaaataaacacagtttttcttttatctcactgtcaacccacatttttatttcagtttctttcttcatcttcaatcacatttgcaaaattcatttttgccatatttttaatgcttatgactgtgactacgagaatttagaattattaggatcgccaaatcttttttgcca

SEQ ID NO: 6248 - DNA, 1300 bp, Glycine max
  Soy_ogl_6390 Gm19:33631101..33632400 Cluster 27
tttttcaagattttgccctttcttgctccagaacccttccctctagcaaaccaacaatagaaacaataacccatctcaagactaacaaacaaaaggtttttggcatcatcaacacttaaggtgctcaactcaaaactaaatagtggtaggattctcacttgcaccaaattcaccaactgaaattaagtccattgaacatctatcatcgcattttcctttaacatacttgtcttcattggcggttccatcaatttcacctccttcaattgagttgagagaatatacatcatcaaactgtatcaaaacagtaaccttcattatcagttatagaaaaatcactcccttctattgagtccactgaacatccatcatctaattccatatcaatacagtcatcttcaccactatcacacacatctccagcaaccacatcaattggagtgtcctctaaacccttccacaaaaaaaaaaaataagggtatatatattcaataacaaacaaaattctattcacaaatctacagacttaaacattggtacagtacatttatctatacaacaatggatccaaagtttcaaaaacagaaaaataccttgcaagttttggaactaaatggactatattcaatatacgaacatgctccaccaccactaccatccatgtagaattccataatcaactcaaaagtgccccgtcaaaagcaatattgggtaaacataaaataaaaaattaccaaaaaatagatagaatgcccaattcctgaaagtactattgatggtactcttctatcacttgaaaaaagtcccatatattctaaagggaaaaaaatgccgataacaatatagtttgcttcaattttgcatagatttgcgcacattccaaggagaaaaaagagttgcacacctcatcttatataattataagagctgcagcttaacttcacaagcaattagtcaattagaggatacaactaaacgggaaatagtctcaccgtaagcatgaataaataacactagtcaagtacgggattaaataagaaaggaatctagtcttaataaaggatcacttttattattcttagacatgttttaattcaattaaaaaacttagatacaatttactttagtccccaaagttaaattaatttagctaccccattcctagttcccaccaacgagaagaaaactcaacacattataaactaaaataaatccataatccaaaaaattcttcaaactaataaccaacaagtaattgttcttcttttcctagtctcacacttcccgacaccttctcata

SEQ ID NO: 6249 - DNA, 1277 bp, Glycine max
  Soy_ogl_519 Gm02:12741297..12742573 Cluster 27
tgtatctttataaaaatatttctcacacaagattaagaatattaaacttaatcttatgattatacatgaataattaatgatcacttaaagaagttaggtaacttattaatgttacgcgttgattgagcgcctaagtggtattaggcttggttacatgattcagattgtgacatccttgatgaatgggtgaactaagttgtctcgacaagagagagaaacatgtatggagaagagagaaaaacttgggagagtcaggatgaccacaaagatggggtaatccagttgacaatcaaaatctgtcaacatcaaaggcatgctagcatgatggacaacaaatttgtttctacttcaaaacatgatgggagtaaataaaaaataagaacccattagaaagcaactgttaaatgcaaacctcactttcatcgatacggtcaggttttttttttttttcttgatgaaactatcccttctcaatcactacatgttcaagcttcaatttgctggaagctcttttcaacatgcaaccttataaatagactttttcatgtccatctcaatataaatgatccacaagtcacactagattgagggcaatatacaatattgctaagtacctctatagattgagcagttgagagcctataaacatggacaggttttgtctgtggcatctatccatgacttgtaaatccatttgaggattatggaattcaaacaaaaaagattataaattaaacattgtagagcaaatagataagatgtgaaacaatgaaaatggcaaaaaataccaagtcattgtcagaaagaatgcaagtatcacctagagagaggttaattccctcccaatccccagtcctagtagtaagaagaaaaactctaccatttctatttacatcattgaagtcctagatctgttcatgagcagaaaagttacccatgaactagacttaaatttagccacttcaatctgcgattagtgattaagaacaacatttgcaaatacaacatcaaatgataacacaagtatattgcaattagcattcatgttcaaaacaggcttaaagcttcttaatctactaatagtatgctaactaaaatggaaatggccaataatactttagttttaatgaaataatttatgcatataaataatgcataaaagaagacaacggagaaagcctgtcgtttatatatttaagatatgattacccaacaactataataatatcttggttatctaggatacatgtgtaatcttcaaaaagaaagtgctttta

SEQ ID NO: 6250 - DNA, 1138 bp, Glycine max
  Soy_ogl_1626 Gm05:29016063..29017200 Cluster 27
gcagagtgttcaaacctatatccatgtcttaagacattcacacaactatagtatagcaacattcgattatgcagtcattgtgctatacctatgtgacaggaaagaacgaccaacaccataatttattttggaaaatgtgatctttgcattttttatcattagccaactaagacatagaggaagaaaactacccacggttgacgattagcaatattctcccattcacggttgctttgcggtacatcaatggcagagcggggaacgactttcagcgaggttaaagagtgtaaacgaccaaacgtgataagagaaattatttacagaagttttaaatttgatttgatcataaacgtgatttgtaaaagatatgcagttaatcagatttacatttctccaagatttgtagtttgatatcagattttaaatttcctttttcgcaattatactttaatgtcattaagctttgttcccttgtatgccacatggcacctactactagcggatcacaactgacgtgatggtcccaaaccaacatataatatctcaattagatgacaaatataaaattagttaatattaccaatgtataaactttttcaataacttatgatgatatataaatagttgagagtttatgaattaaaatcttaccatatatccatgttatttttttatgattggagaaaataaagaacaactaaattgcaactaaatgcgaaaaagaaacacctcgagcatcctccattaataacttaaggagggaaggagagggggaattcaaaatcaaaaaatcagtacttagctcatgagcatagctagctaatagatcaacacatctattagcctccctgaaaatatgactaacatgaccaaaccggttataggaggagaggagttgcaagatgtcatcaagcaaaggctgcaactatttggagttcttcctacggtcctctatcatcttgatcgcaacttttgagtccatctcaaaccacacattagcaaagttagcaaagtgatcgatagccatgaggatacctttctataaagcccaaagttcaacccaaatagcgttgcatgaccctaggttagtagcgaaagctttaatttaataaatctacctaatgaatctctaatgata

SEQ ID NO: 6251 - DNA, 1500 bp, Glycine max
  Soy_ogl_2030 Gm06:22581101..22582600 Cluster 27
aaaagtatatagttggaaaagcacaacctcataggaaactcaatgcctctaaggggaaaaagaaaagggaaatgacactaacgagtgttgtgacttatattcctttatgagaatgttgttaattcttgatagatggatacgcataggatagtgttttgttgcctttcacattctctatctttgaaataaaaggtgttgcctcaaagcatttatgttccacttttgtagttaggaggaggggtttactttgaaatgagtcacgaaccattttcaagctatgcctatatggtggctaggtgctacttacacggctaaaatctcccccttgagggacaatgaaagcacaaattgtcaaaaaggaggcactttgtttttagtgttttgtatgttataatggtaacttgagttataaatgtacacacttcattttcttttgcataactttattttatggtagtagatgttagaaattgaattgaacaaaactgaattctttagtccattaattgaatccaagctaaggaaaagggttttgtataaatgagcctgtgttgacactctttttagtcacatctattggagttgtgaaagatgcagaaatgggagttccttgcagcccaaagcttcaaggatgaaattcttcctgcggttttggactgaagggagctcctacttcttcactttcccatattttttttgtctttgctttttatcgaaccaaaggcttcaaacttttcttgtaattagctattgattccttgaagtttggtgatctcgttatgcacttctgctgcagtaagtatagattttcaatttttagttttaccaaatcaaagtacatcgtcatttccccttcccttttttttctcatatgacacttcttgcaaatttcttcaaagggggaaaatttatcaattaagtatgcactttatgttcttgtacatttatgcagatgatgcaagatatataaggtcacctttataatttgttattgttttgatccccttagttctaattttttgatgttgtcccatttcccctcccccttcatttcaatcttcctagatgtgtctgtacagaatttacataaccaaacttaagattaatttaatcgttcaaactaagctaaaaggattgatttctttggagctgtattattttagctacaaaagcccttgccattcattcctttgataaaagtgatcatgctatctccttcagataattgctaaagctaaacctcatgatcacacatgtaaagctgtttcctttagaaaattgttattttatacacattcaggacctgaacctaagctagaaaaatgcctaggtaactatttttctccatgctgtggctattttgtgtgccacatgcaagtactcagtttcaagaacttaaaaactgtttgtaattcaagaattcaaaccaattcttcctccattaattccataaaatatctttccattttctgccagaattagttcagtgtcaaattttcc

SEQ ID NO: 6252 - DNA, 1210 bp, Glycine max
  Soy_ogl_2047 Gm06:41199901..41201110 Cluster 27
tggtattgaaaattgctacttatgtttttgagtcttaattagactacatgtgttgagttctgctttggttattgcatgctaatggttgtttcttatcaaaacgaaaaaatgtttggtgctaagatttgtttttctgatacatggtggagctttggcttttggtattttgttgttttgttcccttcttttatatttcccttacatgaatattgaaaccaataagcatgcacttgcacatttcatagatgtcaactgagctaatagttaccctttgctagattctgatatcgagcaagaaagaagttggacttgattattcttttacatgtgatgaatattgccaagtttgaagaaatttatctgaggatatatgtttgcaacaaatcccttaattagcatgaattggggctttagtgtattgaggtgagatttacaaagcaccgatactttaatttgtctcatgtatctgtatcggatacgtatttgatattgatactcttgaatatactttaccaatatgtatctgtgaagtatctaagcctatgaagcactaataattcaatttgattcatgtattcaatatcgatatccttttgatacttcgatgatgcgtatcgtgtgatatctaagcttttaaagtattttttgaaaacccaatatgattacataaaacacatatgtataatatataaacatagaatcattgttccttgatgaactaaaaataaaaattgttctcttcatgaataatttcaagaaaggaaggagattgatagtacgtttttcatatgtaaataatataaagtaatttatgatgaggatgtgttataacttattttttttttatttttagtaatgttcaagaaatatgtttttaatttgagtttacaaaattgcaattatatatttaatattttgcttttctgattatttatagatttttaaatatgtattttatatgtatcatattctatatatatttttgaaataatcgtattgttgaatcggatacgtatcatatgtgatccacccacttatcgtatatgtgcatataggaaatttgaattgttagtgaatatatatatcggaaaagttatgtcatgaaaagagaaatccaaaagaagtaatgatggcttaatggagcattgggattgaggagttgactcactcacccctgcctcttgactccttggttctctgttatagactt

SEQ ID NO: 6253 - DNA, 1456 bp, Glycine max
  Soy_ogl_3071 Gm09:28556201..28557656 Cluster 27
aaaacatcagtccatactgagtctgcaaatggacaagtgagaaatagatgttttacctcctccactgcagaatggcaaaacattatggaattcatggttttaaattggagccacagttgcgattgtgttgtagtgagcccaaaaacctttatattaatatactgctgatacgatcataattgtaattgtagtgcggtcacgttatgattgtaattgcggttggagagcactatttgaaaccctgatggaagcctttctttttgcatgtggttaccatttcttgctcctttttcggctgatttattagtcggatatgttcgataggatcaagaaggaaaccttgaaacaagaaatactatagctaggtattagtcttaggtccgtaaaagttcagacacgtgataataataaatatccaaaacgggtttgtttcaccactgtgatgttccattttgcttacatatatatggacgtgaacattaaactttttcatatattgacgtgaggcatgggcctaacttgcatgacaacgataccttttattttggtgccaatgatcgaatttgaagccatgcaagcacggaggcatggaccctttcttctttctatcaagttttgccgatgaatcttcaatttttcccttgagcttgacaagcatgtcacgacaagattctttcttggatttctcattttcattcatacttttggctgtagcatgtaatgaagcaaaatttatctgaaacagttgatttcttcacattgggaaaacagaattcattctttcccaattgtttgttcattattacaagaactgatattttaagattgtccaatatatatcctcgtgcaaaatatatgaaacaatgttataaaggttgatggagaccagccatgagtgtttagtcgatttcattgatttttatcagcttgctttgaaattaattattgttgaaagaccggccggaggctagaccagccattaggaagttggagttttttttttcttcttacttaatgatattatttatctttagatatatgtgcaatatatatataattcttcaattatatacaccatgttaagcccttgatccctatcttataaaaaaaattatatacaatattaacattgatatattgtgtcaataatttgagctgacccagtttatgtcccatatgttgttagatcttattttgatcgagttctagaatatgcgtttctatcaaaatttctagttgaattaggctgaaggttagcaatagattgttttaggtaaactataattttgatttcttataattttaaatatgtaactttttctaattttcaaattaagatatttatttttttaaaatttttttaagtcaataattttagtcatttattcagttaattattcaaagacaaatgttgattttcacatgaaaaaaagtataatttagtcaaaactttata

SEQ ID NO: 6254 - DNA, 1279 bp, Glycine max
  Soy_ogl_3091 Gm09:31670022..31671300 Cluster 27
cataaacacatgtgttgcaagaaaacaatgactcaggattgaaatttttttacgataaagattgaatgttaacatgcagaagtagacttacagtccaagtggaagtgtgtgagaaaccagtgagaacaatctcctctgagatatttgaaagcatcctgcatatagtaaaagtatttgtcaaacacccggacctacattaaaacaagatggggcaataatggtgataaaatggctgaagtttcttagatattgaagttcataattaattggctaattgcggatgaatattcaatttgcttttcctagttcagaaggtcaacatgaaacgtgattgatgtgcatgcttagtttgaattgtcgtccaactagcaataagcattttcttgaaaggatatggagttcagttaccaagcaccacacatgaaaaaaacccttttccccataaaaagctttccttctagctaagatatttccacacacagtccaaaaggaaggcataaagggaatttacattaacacaaatcaaatacacatgtatcatttaaattgctatttaccactcggaaaggcgatccttggatggcacaccatttaggaacatcatagagcattgtatttgttggcgtattttttgatttgtgcttacgaccagaatccaagccactgtttttcttttcttgtggttctccgggagaggtagaaactttcttttctttagaagcaaatcccgaaaaatattcagtcattaatttgtttgccactggtttaccagtgccatcaacttttctttcagacttgtcatgttttaatttgactttctggtttctaatccttttaggctccgccgaagaatcctcatgtttctcatttgcaacagcatctccttttctaagttcacttagggcatgcacaatctttcttctcggcccaagtgcagcaatacccatgcttaagagatcctgcagatagagacgaaaaaaaggaaaaaaatcaaataacatgaaactttaacaaagtaaacaggaagacacttaacacaaacaatagtccattagtgttttacatgctcgataattattgcagaataataccattttcaaattaaaagatttaatattctaattaaatgatttaacaaaggacaaaaaggctaactgaagaaaatgaagtttgttaccttactgatgtcaagtacattgaggattcgaccaatgagctttccaggaagatgaccatagaaatatgcaagtatatgctggatattcaatgtacataaatt

SEQ ID NO: 6255 - DNA, 1200 bp, Glycine max
  Soy_ogl_3882 Gm11:21437001..21438200 Cluster 27
tatatgttaagtcatatatgttatgtattaagtcatgtatcttatgtaattatgtatattttatcttcaaaattcaaatattattttctttaaaaattttgccatatatgttatgtctttttatatcttttcagatttcaaatgaaatataacaattggatatgggatagcattttgcccacgggaaacagttagccaagtaggaaaagaaaagattggcacattatgtttgaagtgactcttattctgggtaacgagaatacaacacatctctatcataaagattaggagtgatacatatgaccaggcaatggcaagtccagttgaagcacacccttagagaagggaattacaaaacaaaatgagcagtctccaaaatttataatctaaaagtcagacaattaatacttttgtctgtatgttgaagaagttcactgtaatcattataaggtgggaagtgatttaaaaacctaataattatttaattagcaaagatataccattatcattgtaggagttaaaatctcgatcatcacatgcaacactgttaaacatgaaaaagttgtacataagagaaaacatacccaaatataggaacaattgaagactgatttggtgtatatatagaaacataaaagtaataattaaaattcaggtatcctagaattgacaataataaaactcataaatcctttgtttctttccaattgtatagttcaagtagtagaaggatgcttcttgcataaatgtccaaactcccaattctccccacaaatgtagcagaagttgcgtccacacctgccaaaacaaacaaaaaatggagagataatacgataatcaatttccatatttccattattatgaaaatcacgatgaattatatagtgtgcaaatcaaaagccacaaaaacgaccatagatagataacagaacctgcaagtaatgtgttcacatccgccactactttggacaaacatggtgcacttgggacatttctgccaattttcctctttggccaacttgaaaaactttttatccatctctttttcatccatgatttcagggattgaccactctttgcgagaagtgaaaggcactgaatgctttcacttgcgtattgttagatatggtcaaaataccagatgcccattatatataactacattccctacgttggaaagcttgtttacattaccgatgg

SEQ ID NO: 6256 - DNA, 1000 bp, Glycine max
  Soy_ogl_4065 Gm12:33413701..33414700 Cluster 27
cataatattgtttacactaagaattgtaattatgggttaaactcaatattatgagttaagctagcccaaacgatcactcttttctcttatgaatattatatatatgattagaacagtaaaaagagtgcaaatatataaagttttatctccaattaatagtctctatttttccgctatagtaaaattgtccaccccttactatccttcccccgcttaatgtactcccttccctaagatcttagtatatacaataagcattgaatagacaaagataccatgtaaataaaccagctcgaccaaaattgtagagtagtaacaaacctgagttggtttcctgcacaattagtgtaaaacgacctctagtcaccacacagtatgccagtgtagtcttgctcctttttaccaatgatatgctagcacctaacatacaacatcaacaacacaaataatcaaagcatggtgttgtgttagattcccactgcatgaatgaatatgaaaagtctggttcaaatgtttttaaccatgaccaagattggaacaaaacatcctgcatcattttatccatgttgaagaccatgtttctaaaaatgatgtgattcctccaatttcaaaccgaccaagttatctcagatcatagcacccttcacttcctattatcgggttgtgatccattcatgagtacatgttggcacaaatgttcttctatatattgtttttggaaatacagttgtgattccaaaccaagcatagcatcttaatcaaactgtgtataacctcacaacatagcaatatctgatcgagagactcttcaatcccccagcagaaaggacaattgcaacccgattcttgaccttcaatgttcctccttccaagattatcaccggttggcaacgctttcctcaccatgctccatacaaaatggttattttcggaggaatgtttatcttccaaatgaaagaaaaggtgtcttgattgccattgtttataacctcttcgttca

SEQ ID NO: 6257 - DNA, 1300 bp, Glycine max
  Soy_ogl_4165 Gm13:12441601..12442900 Cluster 27
tgttatgctgattattatatagaacttaaagtagttaattaggttctattcaaataaacacttatttaattaatttatttaaagaaaatctaattgataatagtaagtttaattgcaatttgttttgtcaagaaatgcatgttacaacattataattaataatgtttgcgatctcaattacgttgacatcccaaacactatgtatcatatatatgtagcacatccaaatattactaataaaacaaagaaaagaaaaacatgggggacatgaatcaaacccatgtatacaattatgtgaacttaattaaacgatgaaagatcatatctattatgaaaaaaatagtatcatgagaaaccttgtttgctagtatcatgagagataaatttatttgcacaattgttaccttcatggggaatatgaaagtatctaaaattcatcctattgacaacatgaagttattgtccttctatgtcttaattaccacatcatagtaactgttgttgagccttgggttactcaatatttgcattcattttgtaaatatggtgtaacctgatggtatgattgttttattgttgattggatgatcgtagggatcttggattgggatatggttgatttgtaacttttaggagggcatgtcttatacattttctttactcaatataagtatttatttgctgacaaaaaaaaaaaaaaaaaccacatcataatagtatcgaaaaaaggttctgaagatgcaaatgtgtcttctttacctgggcagcaatgaagaatagaaaccttccgttttggtttcaaaggtcattaaataaatcatcacacacgaaagtgataagaaatagtatatcttacatattttattgtaaaaaggaaaaaaagagtaacaaaaggggaacctaaactgaacagcaggttgctttactaggggtagggctatacctacccttaaaagctaatccgacactaaagctaaaaattagttgatggtgatccaccctccaaattatgtcccattgtactatgtcttggctcgtggaagtgagcaagataacagggagacaagcagagaaagggagaatgcccactcataaattttgacttgatttgattccttaacttcttgtaaatgtacctgtacatgcatatttatatatgcgcggaaaaggatccttttatcatttgatggatattaaaaatacaaaatttcacttgatcttcttatgtgttaaaattcaatatgaatggattcattcagataaatgcaataagcatcccatgcaaattaatatacattga

SEQ ID NO: 6258 - DNA, 1077 bp, Glycine max
  Soy_ogl_5048 Gm15:14573401..14574477 Cluster 27
gaaaaatggtataacagataaataagaggtataaaagggtatacttaggaaaatcagggtgtaaatagcaagagccttgggaaaatggcgtttgaatttgtgaagaaaacaacaaaaatggcggcaaccagtgtcactactttccgcgttggatcagatcttcgagggcttattattcgaattcaaagcaaacacgttgatttttcctttgttcgttttctcaattttgcgttaattttttgctcaggatacgaagagtggcatttcggagatgcagttgctgcaatccaactacaacgcagagctcaagatgcgcgaatcgctcccaatctctagcaacgccctgaaaagaggttcgttacactacaatgcacaggtctgcaaaactgtactcggagtccttgaagaatctggcggatcaggagctttgattgcgaactttcgcgaccttaattgtgactgcaattttaatttaaatatagttctttaggtgcttttagtattgttttctaatcagaattagagttttatcttgggcgcaaaaacagtttgaattaaagattaatacaagtgaaatttcaattctaacttgagaacagtgtgaaaagtacttaacgtgtatggtacaagcaatatcatggattacgctttcggttcttgaaaactcttgccaaaatattttgtattcaacgtgtaatttttttttttacattttacaaacgaaaaatatccactcaactgtaaatgctgatttgataaatatgcaagagtcttgataagataaaagtctaattaaatatatataattcattttcactcttattgtgcataatgaataagataaaggaatatgatgggtggacatttatacaccacctgacactaagagaaataaagagataaaaagagagagaagagtgtaagtatcacaactaatataatatgatagcatcagaaaaatagagaaatgattaatgttaataggatgttttgtaacagaaacatgttcatatattattattctatgacaaactacattacctttgcaaataaggatttctgtgtttaataaaatga

SEQ ID NO: 6259 - DNA, 1000 bp, Glycine max
  Soy_ogl_21 Gm15:15947801..15948800 Cluster 27
tttatttaattattaaaacccttgtgattttttttgttgcattttgaatatggaataaaatatacacaatgaaatcaaatgtaaagaaaagctaattattgaatatacatctatgcattgcaaataaaataaagtgtaatagtgctacatgctcaaaaatctggaacaaatatatatattaatttagcaaaataaactattagtgataacagtaaaatacatgcaagatgaggaaacctaatcaaaatataacaggacgtgaattcctaagtgacctacaaggctttaactttatgtttggaaggttttaggaggatctttctaagggatcgtaatggttattatagaccaacaatgttgacctctcattagtgaaaccacaaaccaatcttttgacacatcatctactcctacaacatgaataacacaatcatcactgaacatagacgaaaaaaaatggaagcatgcaaacatatgtactttaggagtacatgtggataacacccaacatgcatacaataaataccaacaaatactagcaaaaattcattcattcatcaatgcataaccaattacaagtttaaccaatgcacatagactcatgaatgtgactaactctactacatagagtttgtgaatttataatttgagcaatgagtccattatgtcccttaacatggtaaaatatcatcaacaatactctcttaattggtccaaaagcacaaaacatgcctaaagcatacgacaggcacactaaaactttgatcagcgggaatagttgtggctttgtcaatatattcatacgagagtagtagttaccatgacatgagctaggatgcatagcctcaagcctttgtggaatcacgtgtttgaatgctcccaaggtaaaaacataaacctacactagcgttccctcacatgtaaaaacaatagagtgtgtgttagctttcaacaacttgaagcatgcttagatgtacaagacaattaacaataatgcaca

SEQ ID NO: 6260 - DNA, 1078 bp, Glycine max
  Soy_ogl_5075 Gm15:20641623..20642700 Cluster 27
gtgcgttgggatgagaaaatgaaaaagatgatggtttttttttttttggaaggcagataataagtatattaatatataagcagcagcagtgccatagtacaaaaagataaaagaactataaggaaaattgcagatcccgcaaccctccctatgtccaatgtatgtatccatttctttcctctatcaggttctagaatccggctttatattaaaaaaaggtctgaatatatataacaagataccaaaacacataatctatatctacatgcaagcattaacatcaaagataaagaagcatattttctgtctctatgtatcccaacacccttcataacatgttccccacaaaactgcaccacgccctaaattttcagctgggccaccaacatatcacttcccttgcatggtaactttcttatatcacagcagtatttccaatccactgaccataggagtagataaatttcggaactttctcttttatccacatccacatagtattgtatctcttctagcagtttgcttttatccaacacctcttcttggaatacaaatctgttcctggatctccaaatacaccacaaggcagaacaccacaataccttccaaatagtgttgttttgaaacctgttaatcaatcccgaaaactgccagaagtgttactttgcattccttgccattgctgtgcttgtacctatccatgcaaagcattgatgccagatatgagagacacaattgcagttaaaaaataattgctccatagactcttcacatcctttacagaaggggcacacactatcctcgagtagcagtggaatgtttctctttttcagattgctcttaggaggaatcgtgatttttcatataacagagaagatatccacctcatgactgtctgtccgcaaagtatgcaaagctgtgtaagtaaaattaacagagaaagaacttgaagcatcaggtaagcagattaaaactatcaagtaattgtgattcacaatttaaccattgctgtcttctttcactgaagaggatgatgtgcagttggttgtaggaaggtaggcactcacacatgcagttg

SEQ ID NO: 6261 - DNA, 1400 bp, Glycine max
  Soy_ogl_5090 Gm15:32478101..32479500 Cluster 27
aaattgaaattaaagatgaaaaaaaaatgttctaacacgctaacaatttaatacatcaacttaactatatttaagaaattatgaagaagtaatatgttcaaattaatgcacacacttataatctcaacattattctcagaaaatgtgaaatgaatatatattgttcattatgtcttttttttctctcctttgaccatacattctatatcatttcatcgtcatcttctggaacaataatttctttttacacaatagatgaaattatttaccacatttgcaggaattaactagaaaaataaaaaaaatataatcaatgattagtaaagaagataatgacaaatatggtgaaaaaaggacccaaaaaaatgatgccacttttcaatggttaactcaccaatgtttgtcttccgatgacatcaacatgagattgtattttatcccatctccagtaaaactcaatgctgacaaaaatctttattttcttgaaaaaatacattctattaacatcttgtgtgccctctcaagattagcgcataaaagcgtctagtttttttggttagagcagacatgtgagctctgctagggtttctagaaaaggagtggctgataatacagttgaggagagggacctcctccaaagaagcacgaagaagattaaagatggtgctagacatataagagtgaatcttcgaaatcatatgcgaataaactgcatcatccaatggggggtgcagatggtgtgggagtggagatagaaaaggaagtcgatgataacgagacaatttctagggatggaccaagtatcccactatcgtatgtagagttattcagatgaccattcatggcttaacaccttggtacgtggttaatgtgttggaaaggagggcgaattttcatctcattgaagcaaagattcagaggagctggacaacattcaaattattgatctatacgatggtttctactaggtggttttcagtagtcaagaggattataatttggctctttatgggaaaccatggatggtcgctgaccactatcaaattgctcaacgatggaaaccattctttttaatgaatgaggaaacgaccaagcatgtggcggttggtttaggattcagtgattgcctattgagctctataataatgtcttcttgaagaggattggtgataacttggggaagtttttgaaggtggttagacttatgtctataatatagactctattatagtcacatggaaagtttgcgaggatttgcattgaattggatttagacatgcctctagttcctcatatttagatcaggggatacaaactgaatttggagtatgaaggcctccattcaatttgtttccaatgtggtcgttttggccaaaagaaggatcactgtgtagaacagg

SEQ ID NO: 6262 - DNA, 1000 bp, Glycine max
  Soy_ogl_6089 Gm18:43706901..43707900 Cluster 27
caaagtgtgtctagattagagcctgtaaattttatttttaattaattcaattttacaaattattttttggtcaaaattgaagtagttaactggtaacatgatttatgtttaactaattttatatcaaacatgattttcaccatatatttgatataagtgttctatgtgtttcattctatgtctttgcaatcatgtgtgtttggtcatgcattaaggatgtggtttttacgtcttaaccatagcaactttaacttttatatcatttaggttatgtttgttttacccttttattccatgggcatgtgttccaaagcactgttttatgagagacaacaatttgttttgtctccttgaacgtttgtttgcgggatattgaaaagaaaaacaaacacactcaattatggatagattatgttttttgatccagaactttttgctatttttggttcttaaattttttgacaaccagtcaacgagaactgtcttaatatttcatccaattgagtcaactccaaagccattcccaaacccgcactggcattgccttcatagtggcgaaattaggtttcgcccaaacacaacacgagctcgaagttcaaacaaagcgaatccaaaaccttagagaagccttggcgaaaacggaaaaagcaatttactttggaatcgacatcaatcactcggagcttctcctttagagtactttaagcggcaagcatcacgatttcatggcggaacgttgaagccctgtgattgcggtgataattgcaagggtttcaatggagactcgagcgacacggtaacaagatgatgtagaagaaggggagagaagggggagggggggtaagcaccctaatgttagtgaaaatgagtattgaatcaggtggggcatgacatgagtagtaaaaattgggttcgattgtagcggttaatttttcagtcagaattgtaatattttttagaagtttatttagaccataaaaaacaaaccgaaggcaaaatt

SEQ ID NO: 6263 - DNA, 1100 bp, Glycine max
  Soy_ogl_6091 Gm18:43729801..43730900 Cluster 27
ttttaagagaagcactagaacacttgtttcaccttttggaaagcttgtctaataatagttatatcatattttttaatagaaaatgtttttcctttaaaaaggcacaacatttgcgcccttaaaaagtaattttggaaaggatacgtaaaacatattcttgtcaatgttgtgcatgacagatgtttggtaaacttgtttcagttggcatgactttgtgctgtaagtactactattgaaccctcaacaatgttttctattattccagggatggtgcacaggcaatgtggaaggccttttgaggcaaaaatttatgaacaactggacaaggttatatttcttttattctttctctttctgcagttttacagttttaaagaaatctttttgaataatgtagtactactttaaaagtcattaggttacaactgtggttagtactagtgcatgtttggttcagcttactttatagaaataatcacttttttttgttactgattaaatattgtaccaagcatgctactagttaaatattgtattttatctatatctttgtttatctcctttgtttttgtaattatatatcttatctaggtgaaaaacatattttatattcatctttatggcttggctgaaaagttcattatctaggatgtttcaaggactctgcatgaatatcaatttattccagagaagccctctgttagaaatgagacatatgagagagttgcaccctctatccactatagttctcttgatggtgttccagattctaggactttattatctaatggacgatcttttctcaatggaaatgaatctgcaccttatggatacggaattcgaggtcagatacctggtctagatctttcctcgatgggaatgaatctgcaccttatggatacggaattcgaggtcagatacctggtctaaatcttttgtcacagcaaggtaggcagaatcatcttttgccatctgcttcaggagagaatgacggtgttccacgaaagaacccatttgttgatgtaactgctgacattcataatagatgacctagattcattcttgggctaaaagacactgaaaatccttttggaacaaag

SEQ ID NO: 6264 - DNA, 1200 bp, Glycine max
  Soy_ogl_574 Gm02:21962201..21963400 Cluster 27
tacgtcacactccatgtgtgcaaattagttgccacgacattgactagtctaatggagtaatttgtcagctaattcacgatggagtaatttgtcaatattgatggttttaaatttttttttttacagcaggccattattattgatcgttcccatattatccctcttcttctcggtcaagcattccaccactgtcactctttccgcctcaccgctccgtcatctccacctttgccgctggcaaaccccccatctccaaccacacctcttaacacaagaacctaaccaaaacaaattaaccgttcacacaacacaattaattttagatcccccaactcagaccttatagatcaaacaatagggaaaataatagcacagaacagataatatcaacaagcaaaaacacctgattccaagtaacccaatatttgataaaaggtccggtttccccaatcacaacggaagccaagttagccagaacctgaagcggaatcacaatcatcaataccttcttctccctatccggtaaacagtttcagaaaagactgtcccctgcctcatgcaatttgttgtccctcaccgccaacaccaacctctcgtcggacgctaagtgcccatctctgagttgatttcgttgcaaaaatcttagcgcacatagaatccaaatatttcaggtgattgaggatgcaaatcaaataaatccgaatcaggcgaagcaaagccctctcaaataaaaaatccaaagaaaagccatagcaacaattagagcaaaatagcgcaatcgaattgagtcaaagaagaacaacacaaatttgttccttcagtgaataactccacgatagcacaaatcgcgattcgaaccacaaggttgaaagtttggtttgggtaagagaagcgggtggaacacgtgcttgcagtatggaatcatcttcatctttcgccatcttgcaattcctctggacatatcgcgcactccgcgcctccatggtgtgacaccactggcagacttcgcggctgaggcctccgcccatggtgcgacaaaacacgacgacggaaggaggcggtgtcagaggagaattagcggaagtatgggaagactatcttttatcaataccttcgagggacagcgatttggttgaggcaagggaaggtggtacataggaatgtgattgaggtcggtgttaatgggggtactctattact

SEQ ID NO: 6265 - DNA, 1362 bp, Glycine max
  Soy_ogl_2032 Gm06:37758819..37760180 Cluster 27
taaaaaatttaaagaagtcactattaataaaaaaataaaaacacagggacgcagctgttttaaccgccgttaaaggctacgccgcctccgtaggtcttgtccgttctactacgcgtcgcgctcgcgaagggagcacgtggccatgttttctccagctttagtggctggcgggacccacatgattggggcggcgcgggtgcttgtgttgtggcacagtacagtgcagtcaaattttgaaaagccgaatattacatatgggtttgtttggactttggagattggaattggatagagccatacatagaaaaaggtttctccgaaccgcattgtttcgtgaacaactgaacatgcatgtgctggcgcgccggtaaagtggcagattggaatatcaaagatcaatatgaaattaacaaaatttggaaacagatagtccattgatctaaagtaggaaaacaacaatactagtatatcacacgttcttggtttgaatcttcatttatctttttaagatgaggaaaataacaacacttgaaatatcttttttattttcttccacaattttgctaaccaaaaatttgaaaatagaccaatgtgtttatctgtttgcattttttttttttttggtaatattgatgacactgtaaatgttgaaacaaaattattcaaaaaatattaagaaattttaaaaaagtatctcaaatatgggaaaggataatatattttattgagttggtgagtgagacgttgagatcgagtgtgtgatggtaatactggagtggtttacaaaattagttttaaaaaaatgtaaatcaaaatgattttaaaaagacaattgccatggtgattctctctcttctatttttcttaaattaagtactcctatttattttttctttttttctccttattccttaccagtttctttccttcttggccccattatactttttgaaagaaattaaaacaaataacaacaatctttatgttatctcatgggtaagtataccaaatcatataagtgataaaataaaaaaaatttaagtatcattttacaagaaacttatgtaatattaaacaagtttcacgtgatcactaactaagctaattatcacaaaaaacaataaaacacaaactttcgtagttgattttgtagagcttgctaaatcggaacaagtatatgaacaaagttaaaaataatcttgtgcggttttgtggttaaagcaaagatgaaaataaaatgggatccaaggatgatgaattgtcggagttgaatttaaccaaacttcattcttctactagaagtataaaattcaacttaaatttcgatattaatatcggtgatataatatttttagtcctaat

SEQ ID NO: 6266 - DNA, 1321 bp, Glycine max
  Soy_ogl_2373 Gm07:20589301..20590621 Cluster 27
tgaagttcggttgacacccttggccattcatcgattccttcacaagtacatataaaggagaattcaggatagggttagagagagaaagatgaaggaaagatttccataccttgctcaaaccctatgattgatctagctagaagacatcaacctttgcattcgagggtggttaaaattttcctgcagtggtgctaacagtagctcgagtggcttcttgtaagcgacgacaaacagagacctaaaagatgagtaatattttaaaccacaaggggaaatggttaattggttcggattttgggtttctaaacaacgatggctggagatggaaatgttaggtttttgttctaaggctcaaatggtaaagtgagaagaaggcttttgtagattagtgtgcaaagagagttttaatggtctaggtgacaaaagaagcataagggttaagaggtttgacggtttgttcgtgagatgactgacacacaaatgaagagactttgggttggagaaggcaacttggggattgaagtttcaaagatgcaggctagggagggaatggaaatgagaatcacttaaaacattgtagtagtttgtctttatcatacaacgacaatggttagttcacaactgcctctattttggtgtcgttattttacaaatttgttgtagtgaagggattcacagtcgagaaagtgtggttaatggggatgagcatgtgtacctatgattcgtaaggtgtgagattcttcgttgttgaactgagatccaaatcacgggacaattgtcgttgaatttagatccagatccagggagatggagcgaatgtgaacgagacaaatccagaccctttgtttgcaaatctgactctcttggcaagttggactcgaatctagggtttctcatttcttattcaatggttgagagaagtcatggttcattgaatgatgctctgtgccttcaatggagtcatggtcgaggtcttcaatggtgtccacaaggcctcagcaatggagcttcatgatggtggatggcagtggacaacgcaagagtgatggattcatagagagttagggtgagagagtgaaaatgaagagactgagaatagagtgtactctccaaccacgacgattttaaaataaacatgatgaatgcatgcagccataacgatttttacgataaccgtttttgaattcactaaaccacagtggtttttaaagaactgacatgctcatatccattttttttataaaattgtcaccatgctttcattgacaatggttttttagaaattgttgttgatggagcgtagaagactggtttgtagaag

SEQ ID NO: 6267 - DNA, 1100 bp, Glycine max
  Soy_ogl_2778 Gm08:21353201..21354300 Cluster 27
atttgaagctttctatggtgttagggagcagattgtggtggtgttggttcttttgggttaatgggggtgttagctttgttttgtttatctcattcctgggtttggggagtttctgtggttcggaagagtttaggataacgtgaacgttaaggaagaggtaaaaaaaatttggattcatgaaaaaataaatgaaaagttttgaaaattttggataatcctactcctatgaataattttgttttccatgaaattaaagatagagaatataagataaaataaatcagtaatccgcttaaatttgggtaattctatccccctataacttttttttttcagtgtaagtctgtgttttttgctttttctaaattacatattctgttggaatgaaattttagcactaaaggaaatatttgagaatgagagattatataaaatgttttggagggagagactatttgtataaatcttcttgatttgtggctttattattgagtttcatacaaactttaatacaagacctccattttatattaatgattcctcccaaaccaatgattaagattttgtcagcacacacttaatctaatatttgcaaatgacttctaaaactttctttatccttactcacacattttagaatattctataagttactctagaaattatctacttggaccaaatcatttgttttatctcatccttgttgtggcttgctcccaatatgcttcaccaaaaatggtgaaattatggcacgtaataagaatgagatgctggtgaaatatggtgtacaaccaagtgacatgagagtctgctatcactccccagcgactttgaaaaattaaccaattaagtgaagatcaacaacaataacaggccaaaggattaatattcatttatgtgcatgatgttctcggatcctttaatttttaccattatataacatgcactgttcctcgtattgattttgataagcctttctgtcatatataagtccataatatccgtaatatttccattcttatttttatctgcttaatatatgaccatgagacaagaaactttcttagttagcagcacacttgatatttatacgagtaacg

SEQ ID NO: 6268 - DNA, 1389 bp, Glycine max
  Soy_ogl_3876 Gm11:17995512..17996900 Cluster 27
tctgatgtagcttctcccgaaatccttcattctctggctccttcattctcttgcaacagcttctttcgaaatccttcgctctctctcttgcaacagcttctgccggaaacctccgcacttgttcagctgtcggcgatggtttctgatgactgcatcggtggtttctggtgactgcatcggaaaggaagaagaaaaagaaggtgattgtgttaggattttgataggttctctctcgctccttcattcttgcaaagtttttcactcttctctctctcttgcaacagtttctccctctgcattatttcgaaaaaggttctgatcacaagcaagatcagttctcacctccaccaatgcacttttcaaatagatggttcatttttcattattcctacgattattatttctatctctatctttattgttcaatctaagcgtaataaggcctagatctagaaatcacggtgttcatttatttcttgtctattttcatatgatatgtagtttgtgctggaatttctaattcttattgtgccttgttcgtgcgcagattctgtattccgtatgaatgatatgtctaaatgttatttactagttgtttatgatcttcctgttgcttttgtcttgttcttctttagagtgagaaaatcttatcaatttaagaatttagttgctgttaaaacaagacattgagacatttaagattgaacttttttatgttattatatgttttcattgtattgaggttttctcttgtttttgtgcgaagtgtgttcaataaacaaatattgatcactaatttatacattgcttcaagatgtattctatatgacttaacttgaaagctccttcaaactctttcaagtgcctgttcctcagatcatctgaaaaccaaaccaaaataaaattcatggatgtccccactacactttatataactttactttctatgagattgtaagttttgagctgagaagattccatcctttcctgaattgctcgcagttcggaggctgtgtgaacctcaacactgcatgcaaatacaattgagacaacaaatactatgggccaccttgacataatacaagttgttaacagatatttgcactagagaaaatgatagtcaatgaacactaataaattgggacagagagatgtcaatatttaggcaacatattgctgtttaaaaattgattgacaatggataaagaaaaaatgattaggcaattttatgatttcacttgtaaaggacaactgccttctcattcgagttacatctatatttgaattttgtgacgttcatctgccccacctgccaggcaagatagaaaataagtacaaacatgaagaacacttatagacatagtgataaagtagcagacataccaattc

SEQ ID NO: 6269 - DNA, 1200 bp, Glycine max
  Soy_ogl_3886 Gm11:29859201..29860400 Cluster 27
caatcatggagcacatgtaccctaagattgttgacttgatcataaccaccctacaagtcaacaccaaaacttgtttctacctggttcaaagtgtaaaatcttttacattcatatatcaagccttcaaagcaaaatccatcattttaagaaaagtgatatttgcatcataatgacatatccacatacaagatagagtactgcacgacaacattgtggcggcttgaagtagctaaggattcttgtagggcatgtcaggaggaaggctatgatgaacacaccaaagagtaggcgattaacctgaaagaagatgttagagtgctaaaagctactctacttctattcctaataaaacaccataaagattagagaaaagctataaagaaggtaaaataaccgctttgatttttcattgataatttcttataaagtttaataggaatttacaaatttacaaagaatatcaactatacaactgacacaatctagtatttttttaaaataaaataaaactaaatatcaaaaggataataactaaattatctagacataaaagtcacctatttgggtctctcaaggctcatcctattagaagattttgaccatgtttcagtcagtcacgaatcgtggaggctaagccaatcgcctcaaagacaatgtcgatcacaaggctcatgattacgagcttagcaggggactaagacccgttagacattgcctgaacctttttaagggatgtagaatcaaacatatgtagcttcaaccttgctaagggacttagaatcaaacatcactgcagataacaagtgcagaatgagtcaatgacacatgaaatctcaagaaggtaaattctaataataaaaaaacaaaggaaacaaatatataatttatattcatggtatattgatcttaatagcataaacatacacaatgagagaatgggtagtgttcgagcaataagccagtggaagccagtgattatttttattttttttcagattacttggaagttgtaaatggtatatggatatgattctcattgcttgaatataaggactcttgcttgttccctatctatcttgaagcttcttcaactggaatgatgataaaattaaaattaaaattcactagaacaaacctctacttgagtcattagttaatgccaatagcgagaaggggctaaagtaaatgataaatatatac

SEQ ID NO: 6270 - DNA, 1193 bp, Glycine max
  Soy_ogl_4729 Gm14:7030401..7031593 Cluster 27
ttttaatccactttggataaatttgtctgtaagtacttactgcaaaattacataaaaatgatttatatgaggtaaaatgaattaaatttcttctaaaaattaaaatctcaatttttggcttattgccttttctgttagcatttatgaacttaataaaggtcgacattcttgccttataaaattcttaacaaacagggtttcataattgaaaagctctggtaagctagatgctaatcctgagtctaaatgaaacaagcaaaattgtatttagttctggttgacactgatatgttatagttcttgtttaggttatacagagtgaggaagttactaagaattttgacattgggaggccagcaataaaggcctctgagttgcattcgcagcaaagagattgttctcattctggaaggtgtgatgccattgccggggatgttgtaaacacaccaaagttttgaaaatctcaaactatcaatattggtcaaagagaatttagttaagaaggatagtgcaaatactccaaaatctgaccagctagcatccttgaatctgaaggaagggagatttagttaagaaggtcagtgcaaatactccaaaatgacataatttaaacaatcttaaaaaatatattttaatcaactccattgctaccctttatcatcaatcttttttaatcttcttggtcattgaatctttagtgattaattttaacttgttatttttattatagcattaccacctcacttttgttattactttttaaagtaagtaatgaaatatttcttctttttttttatgaaaataaggtttctaatttttctagtaccaacttcaatagctactgactagattagcttcttttgtatctgtatttgtttatatcactttttttctttggcttccatattatccaatctccatggaaaaaaaaatcaccttgctaccacaaaggcatagacctagaaaacagtgaattgttttaatattttaataaaatttgaatcttcaaatagttgaaaagttgaaatgagagtaagtgattaattgaaagttgaataagaaaaacctccttcgcgtgttgctgggacgcatgcatatgtggggttttaattctctacctgcgagaaggcttatatatagaccatggcggtcctcatattttacggacaccaggcgaaataataaaacgaggc

SEQ ID NO: 6271 - DNA, 1601 bp, Glycine max
  Soy_ogl_5723 Gm17:34514001..34515601 Cluster 27
gccaccttcaaatttgcttgagggtttaatttctcctgctttgcttgctggaatttgcgaatatcatatattttatgaaccaaggttcctctttaccaatcaatacattcccctatctctaaagggctgcattagctcctcaattcgagaaaggaagactcgtacctgttgctgactgggagtttcctattgttgcctattacttgaatggcacccctctattagattagagggcagactaaagatgaatcaggggtgggacatccgcgattgtgacgactgtgtttgaggcagattaacagaggaagaaccaaaaagcagaagaagtccagaaaacagatcctagaagaaagagcaggttccgaagaagcagcagcgcccgaccagtcccagttgacacatatgatgagggagttagaacagctcaaatgacaaatgaagatgatggtgcaactaatgacagctatggtatcctccaggggaatagagcccaccaaactcctccctcaagtccagcagcacaaagtaaatggacaagaaggtaaaaaagaagagggaattcgatcccctcccaattctgccatctcgcctacttccagaattgattgcatccaaacggatcactcccatgcctcctaaaccggcgaatcctcaggctccgggaccagatgcaagatgtgaatatcatagaggtatacgtcattggaccaatgattgctaccatctcaggcatcggatccaagatcttctggaccatccgttgttgactttctatttgcgagggaggaatgcgtattacgctttgaagaatccatgcccttcattgcaggatgaatcagagagtagtagtatatgtaagaagagaaagacgtcccagatacaaccgctcatttcactcaaagataggctcgttcggcctaaggtgaaagacgctgttattttcttctattaaattgaaataacttgttgaaagataattgtaaagcatatgcgtgtcacactagagtgcagttttagttaccccacaccccctagttatttcttagtcagtaactgcataggtattgagtattgacttatgaagttttggccagcggttagagcctaattttggtgtgaaattcttggttagtatttctatatattggatattggggtaatttgttatctttgtttaatggcgcatattatgtttagactaggttaatgttataagatatcgtatcaaaattttacctagagccttttaaaagaaaaagtaaattacactagacaaaacttgcccctaatgttgtttttgcacttattgatacaaaattgcttttaattgttaatgatttttgaaaaatgttatcaaaatttaatttagaaataaagatgaaaaagtatattgaaaaagataaatagctaatcaaattaaatacatgtacaaagattaaaaaaagtgtgatgtgagattgttgacagaaaatatttgggagtaattaacttaattaaatttgaaatttgaaattaaaaaactctaaattaaaaaaatcataaaattattttcattcagaatagttgctatatacataatagttttatattagtgggaatct

SEQ ID NO: 6272 - DNA, 1298 bp, Glycine max
  Soy_ogl_6071 Gm18:19331301..19332598 Cluster 27
aagacattgatgatgatagagaaatgctgatgaaagtaatgatattcatggagatgattctattaaataattggacatgattctttgaaaaaatttgtgatttttttaattatttaaatgttttaattttgaaagcttatattttgtaatagattaatagtatgaactatgagtttattgtcattttatttgtaaaatgatgaattttaaatatatttatagatttttttattttacaaaacgagtcaatgaaactctcactctcactaaataaactttcgattttaataatgttggatgatgacaaattaaatatctatcaaacagcaaaaaatttaaccaacaaggaaccagaattaaaaaaaaaaaaagtaacagcaaccaccatcccaagaggaacaccaaccgtggaaaaaattatgatttatattttatttagagaaaaaaaaatgtatggatttcaacaccagattttcacaacatccacagagctagattcacaagttgaagtcgcaatggggagctagtggtggtgtcgagtagtgcctttcgcatggtggtggcgtcgcccttgcgccacttgacgacgcagagggcatcggggaccttctaggttctcttcttcagattccaacaaaacccacccaacccacaccagggtatgtgggttgcggaaaaggggaattagggatttgcggcggcacatggcagtgatttgagagaggaaagggtggaagctcgccgaggtaaccaaattcagtggcaacttgtagtccacgttgtcaatgccacccctgttcttcttcacacaaccttcaaccttccttccgcagcttaaaacacttccatcgctaccttggttccgctcctcacaatcaaagtatcacattacaaaatatttgttaaaagctccttctgtggggttaactgttttcaaaacattgtggacctaaagattagcatgagagagatttggggtctttattccactctcggtgaccgaatgaaaatcataatctcatatgtataaagcgtcttgtctttccttttttttttggtgtgttattctttttttttctcataaataacaaataaccataaaaacattaggaaaacaatttatgataatatttaaatccagaaaaaatgaccacaaatatttttaaatgattaaaaattaattgtcatatcatcaaatacttaacgacagtaccaaaaatcaaatcaatagttgagggactaaaactaatcaaatattaatttagggattaaaagttcaatagtaaaaggattaaaaa

SEQ ID NO: 6273 - DNA, 1129 bp, Glycine max
  Soy_ogl_6125 Gm18:51082272..51083400 Cluster 27
ccttcgattaatctaatgtttatctaattaagcaacacctccttaatgattttgtccaagttcatgaatgaacaaccactgggtgtagtggcttcctctgccttcttcttcaactccacgatcttttgtctcattttctttcctttctctcctgccatcaagtcattcaccagcttctccacctcttctctcttcatattggtatcaatttcaatcccaatttcccattcattgtagatatatctgcagtttgttggctgatctgcaaagaattgccaacacaacattggtactccagcataaacactttcagtggttgagttccatccacaataagtcaagaatccaccaaggatggttcaacacttgctcctgtggacaccaacttgctatgaggcttttatctttagtttcattcacaaactcagatgaaaaaatcactgaacctccgatgacaaggtcaggcctaatgatccacaaaaagggtttcttgttgttggccaaaccccaagcaaactccaagagttgttctgctgacataactgtgatgctgccaaaattcacataaacaacggatcccgattccttggattctatccattcaagacactttggatcttccttccaaagattggaacctaaagatgtgaagttgttttgtggactttgatttaaaagtaatgggaaaagaccaatggtttaaagaaaagggagcataaaggagagaccattcgttgcatctctctcaattgtgcagtgcacacttaagagaaaggtttccctggttcagatgtgaaagctcagagctaaatgcattgcaaatgtctagcaactttgaacttatgtcgaagtacacatcaatccatttgtcctcccaatcactcacaacaagctcaatggcagtcataaggtgaggatttcatccttgcttttaggcacaagatagtttggtttgtagaatcagctaagcccaaaccctgcagaaaacgttccatcctctccttcacaatagcagggtccttcagacttaaagcaatagtggatagatttccataatctgtaatcacacaaaacaacattgatcactagtttgccctcaaattttactagcatgacaactacacacatc

SEQ ID NO: 6274 - DNA, 1000 bp, Glycine max
  Soy_ogl_2028 Gm06:22003801..22004800 Cluster 27
tttgagagaaataatgtcccttgctgattttataaagaatgtgttgaatctcttttgtgctagctcaggacaaaattaaaggtcaggcaagagaaaagaagagtttacttctctaggaatgttaacaacaccttgagagatcagatagccctagagcttaggtttcacatgacgagagacttggggaaatatcttggcgtccatcttcatcataagagggcttccaagcaatctttccaatttatgcttgataaggtcaatcaacggcttagtagttggaaggccaatacccactcctttgtaggtcgtcttacacttgcaaagccgatggtgcaaacacttcctacatatgctatgcaatcctttttgcttccgagatctatttgagatgaaattgatagaaagtgtcgaagttttgtttggggtgatacggataaaataaaaaagggttcattggttgaattggaatgttttatgttgtcctaaagttgatgtcttcgtcttggagttgggatgtgccttcttggattctcaataatattacgattagcagaatccataatggcatgaggtggtgccagagccactctggactggatatgttttccagcctaagatcgcgccaaccattgaagtttggtctaaagttgaagcgctggttcgtgatattaagcacacttttaatatggaaagcatgtcgcggaatgaggtcactagtagtatccacctgatacgggaatcattaaactgaattgcgatgctgctttctcaaggtgctggaagggaagacgacttgtggtggtttgattttgcgattatcagggccgttttatgtcactgttctaaactgcgacactgttgatattgctaaccttgggctatcgttcgtggtcttagacacgcgcaaaattatgaccttacttcctttagcattttgcatgtgtccagggatatgcaaataagctcgttcctttaatttgctcaatttgcttttcattct

SEQ ID NO: 6275 - DNA, 1131 bp, Glycine max
  Soy_ogl_3104 Gm09:33776670..33777800 Cluster 27
atacaataaaaaagctaaaatattagtatttattaatttatttttattgttttttttatatgggctgccaaagtattagttattatataaattaaaaatatggaagactaaaaaaaagaatatcctgtttaatttgcaattgcatagttagccaacaaccacagtaggtagaaccgtcaccgtcgtaatacgtacgcacaggaacacaaccccgtagcactttctcacgtgcgacgaacctcgcgcgtgccaaaactgtcggtggatcgtaaatggaggagacatcctttgaatttgagcagtgacaatatgtcgagaaagatgtagtttgcttatcttttcgtatcttagtcacgcctccgatgcgcgccacgtgtacccgcattccttgatgtccttagaatcttctttttcttgtctctcaattttagtttggtatatgttttcaatgagggtaataattaaaatcttgacgacttggagtcaattgcaatttcctacaatattttaagtttgtgctctgttttttggttataataatcctgaatttgaatttcaaagtttctgttttcccatttactaatgacagttaacattatgtatactttttttttttaacaattagctgtatcaaattattaattattaaagacttgttagttttccaacgaattcatacctattgtattgtaaaaataccctcacacttgagatattctttcacatgattttaaaacatttcttaattataactaacaatcttttatatctatataagaaaccttcagtactagatatttcaagagcttgcttaaaaaccttaacaaatgtcacaaaaatgaagaataccttagttttaaatttgaatttcattaaggctgcttttttttttttctacttacatgaagacttagatctttgaaagctgtgaaaaaaagatctttgattcagaaagaaaaaagcaaaagccaatagcttgctggttaggttgcattggaaaataattctatgtattctaccagagtttacgcttcaattacagaaagaaaattattttatttttgtttataacataaaaatataaatatatatgaagaaacaaaaagacatatagtgctcgtctattttatc

SEQ ID NO: 6276 - DNA, 1400 bp, Glycine max
  Soy_ogl_26 Gm15:16657301..16658700 Cluster 27
tcaacgatcatgaatattacatagtacttttcattcatattcttgataggcgtatagagtgttcgagatatctatcaagaaagggtatgacattttgagaggttagcaacaccaatacttcttaagccaagaaagaaatcgaaagctatattatcaatgatattatatggggtctctcaggagatggtgtattgattgcttttacttccttcaaatggctcattgcctacttcttactttggaaattggtcctaggtttggaagttgcaattacctgaaaatatgaaacactttttttggctcaccttccacagtagcctccctactaacgattttcatgtctttaaacacatgtcttttgtttcctcttgtaataggtgcacacaaggttaggagactctcctccatttgtttcgagattgcaatgcctctggccaggtgtggcaacatctacagatggattgtgatccaaggttctatactgcagcttgcatccactggctggtgaccaatataaatagtcctagactcctagaggaaccctttttgctatcacgtgttggactctttggaaaaacagaaatgtgcacgcttatcttcctggacaaccgttggagcacttggctcactattaatcgtgcagattctctatgcatatgcaatcaaggtcctctagcatctggaacaaacaacacctagcaggcatgttagctgagagcctcccattttatcttttgtgaagttgaacacaaatgaaaactctctcgggaatcaggagacttaggccttggaggaatcatctagcattggatttcagctttctctggtgcttgtggtgtcacttttagtcttaaggcgaaactatatggaatattttatggtcttcctaaggcttgggaagatggtttcagacatattatatgtgaatttgactcaaagctagtgttacctcttatccagccatccatgagttacatccatactcttgtttgattcagcttattcacgagcttagggacttacaatggacaatttctttcaagcatactcttcacgaaggcaatgcatgcgtgtgtgcattggcttgccaaatatggtgccatgtatggagactcttacttcacttggaatgtttgcccagttcagttaactccacttatgttgactgataaaatgggtatagttcaccttaggccttaattttccagcttgtctttctttttcagatgtataaaaaataagtagaagaatgaatagaaaataaataggatataaataaactaattttatttttatatattgaataaaagaagatagaagaaatgatatgtaggataaatttgaaatagttagatgtgtcaaagtgagtttgaacttgttccaacttgaatcacataatc

SEQ ID NO: 6277 - DNA, 1000 bp, Glycine max
  Soy_ogl_6068 Gm18:18761901..18762900 Cluster 27
cacaccatttgtttgtctcataatcacttgaaagtctaaattctgcattatcaatgacactatctcttgaacaacatcataatgaagatgtgctctacaatttttagctagtatctcttggttggatgactttagaggcttcattacaatcagtctcacaaataatttgtcgatgcccataattccaagcataaaccttccttaatcgcgagtagctctgccctatctgagtccccatcaggaaatgatttctaaaatcctcccatccacgatcttttataatctcgaaaaacccttctagcgtccatgcaattattcatgtgactcccatgcatattcaacttcactagtggagagtcgaggcatttccaatgtatctaattcttggatacatcttttccaacaaaccaagaatgctttgccacactagattggatcatactacacacatgcgaaataaaacattgttgggagttaaagataatattacacctccaacgccatgcccaccagcaaaccttaatcatgtttcaacttcttcatgatacaacactttgtaaatccagttgttaagatggtaatagttcatgataggttgatacgccacaccaatacatagccaaatctcccgtgagtgcaagaaatcccgaagcacatgaaaaatggtttcactgtcaaccgagaacctgggacacgaggctttttgagccaaatgacaagtaactctcttcacattagtaggcagtgcattctggagaatttttccacgtaaagaaacaaagcttttcgagcacgagggcacgccaaatcctcctccagagagggtctgaggtagttgaatctaactacatgacccagctataggcaaatccagaggaataaatcctagatctgttcctcttccaacaaattgtgtttttccctgctaggttaaggggaaccattatatcctttattagatgaacatactgggaaggtaggagctgattcaagtggttca

SEQ ID NO: 6278 - DNA, 1326 bp, Glycine max
  Soy_ogl_3419 Gm10:10280201..10281526 Cluster 27
gaatattaactacgaaaatgatgaaggtagacaattttttatatatattgatgacagagactttagaccacaaggattgtttgtccgcagttaacgttttaaaataagaaaaaaaattgtagtttaaatctcaggattagctcatggttttttaatctgtaatttataatgttgttggaggaatcttaacgcactcactccgatactcttatcttaatattttctttacgatgatgaaatgatattgattgaaaatcatcaattgtagtatgtcacacttctaaactaggaaagataattattaagtaaaaatgtaacctattcaaattgatatttttaattaattttgattaataatattaaataaaggaatattattgagagtctcactaatatttttaatttattataaaataaaagtgaagatcggttagaattttttaccgttgaaaattaagaaaagaaaaataatatataaagggtgatttgttaaaatacatctacgtaagaagggaatgatcaatgatgtatatatatgtatggttattttttgttagacaaacccagtgagaggatgaaaattctagattttcttaagatattcacaaaccgataaatgagttgatataaattagttattttcagaagaataatcaattcatataactttatttatgtagcagtaataattgaattaaacacacattcattctatctattattttttattgttaacactgctgatttttttattacatatataagttcaaatttataatttctttcaaatagacttaatttactaaagttccagttgtttgtatttttaataattttttaatttaaaatatatttctagcttttctactaaatatgatatttaaaaaaatattttgatgttttaaaaaagttaaatatatagagaaatttcttaaaattttcaaaataaattatataatgatatatatatatgtatggaaaaattatagagtgatgcagctattcaggataacaatgaataggatttagataagatactagtacccaaattttaaagaatatctttttaatttgatttgaaccatattctcatagataactttggtacttatcatcatgtacaatacaatgttttagttaaacagaagtgtcatttcatatcttagttatgaaacataccaaacaaaatatttaactatatttaaatttaacataataaagaaattaaaaaatcatgtaacaaacaataatataaacaaattataagccaacataaatttataaaataactcatttacaaatttgtaggtatggtgtttgcactgc

SEQ ID NO: 6279 - DNA, 1149 bp, Glycine max
  Soy_ogl_4262 Gm13:25514844..25515992 Cluster 27
tagttaatatagaaaactacttaattataattcaacaggatataatataaaatagtataattttgtttaaagaatgcgagaaaacgtagtgggggacaaggtgtttgattgacattaatttaatatttttagcaggtattctaaaaataattgatcgttatttcattataagttagttcaatttttttatggattactactttattactattggatattaattccatataaaaacgagttggaattattctattttttaaaaatggaaattatccaattcttcggatcatgattattttttattatgttaatttaattgtcaataaaccttataaaaagaattgaagaaaatatttaaagataaaaacattacaaaatatttaaagataacacaaaatttatggccagaaacatgatttggtataatttaatagacagatttgtccagcacttatgttttcaacgaatgctctcctaaattctaaaaagatgctgaacttaaaaagtggctaccaaatccatattcagcacctccacagccagcttgtccttttcactcgatataataataatatcaagcttttaatgatttgtaataagaaaacataatgcattttttttttatcccctgtcttttaaatttaaatttaggtatggaattatattaaatatttttaatgttatttatagaaattgctctgataaagcatgataaaggaaggagtgaagtatgcacctgtcctgtatcaattttatattggttaattactccgcgggtttccaagtttttattaaatttttaattaagcctatatttttttaattgtgcccttgagcttttatttataattggatttttgattcatttttgaaaaaaaaaatctaaattaatcaaaatatattggtccgtgtttttttgggttaaatttaaatcagactaacttgattaataaaagcaaggtttgatttagattggttcatgggatttgatttttttttttttataaaaaaataatagagaaggggttctgttgaatcggttctaataactaatagggtttttctagtttaattcgttttgtacgctaaacaaataaatcaaatcaaactattttgactcaaatttttagatttatttatttggtttaa

SEQ ID NO: 6280 - DNA, 1016 bp, Glycine max
  Soy_ogl_2011 Gm06:18959899..18960914 Cluster 27
taattgaatgagttaacatgtacatggacaaatttaaatgaattgatttgaatttaattcaaacataaaaaaattcaatctaaattatttgaattagattagatttgcatgacttatacttgcaaatacttttatttttcctttttttgtctttcctatgaactgtttgttaaaaaaataaaatataagtgagccatttaaattaaaatagaattcaaaaattatgaaactcacataaaactcatcatcttatttttcctttatttctttctcatcatctttcctccatttcatttactacctaataaagcataaattcagctatagggaagtgttaaatttggtatgttgtagacccaaaccaaatcaattgaatgattaggcaaagtgttaaatgcacaggggggaggttttggaacatgggatgctatgccaggcaagacaagacgcgacgtggaattctgaggttgaatgatttgatgtgacaacaaaaagcttgcaaacaaagggccccactgaagctacacttttgaagttgtcgaagttctaaacagaggtgagaacgccacgtgttggagacactgtaactttggtttgctttcacagtttagattaaaaacttggcaacgcgtcaacagttgccacgccatcacgtcacctcactcgccccacctatctgctgccacaccctaccttccctgctcatctacatttccttttttcaccgtttcctcttttctattttatttaaaaataattttcttagttcttgtttatgcatttttttttatctttttttaaatataagtgagattgtctcacataataaaaattaactatcatataaatagaagaaaatttatacaccttattctttaattttaaattgaagtataatattaaattcatttatataattgtcaatgattatggttcggtggtaaaattgtctctcgtgtaagatcaagtttgagtaaaggcgtgaatgatgaattcaacaagatcaaaggtatttg

SEQ ID NO: 6281 - DNA, 1100 bp, Glycine max
  Soy_ogl_6117 Gm18:50802401..50803500 Cluster 27
atataaatttaaattttgagatttaaccaaaattaagttatttgcccctctcaatgattgtgttttttttaaaaaaaatctatttattctataattattccaattataatcataattattctattatgtcatctaattttctttcatgaaggatttaaattattattttccgtttaaagatttaaaaatttataataaagttgaaatataaaataaatgttaacatcaaacatgtggataaacgagcttgaatagaaatcacgggttgagacgtggtggcgtgaggtgggatggatatgagtaataattcccatactggttgatatttatataggttaaactaaaaataaattagagcaattttttattttttttatacagttccaaaagtattatagaataatgtaattatattagttttaaaaattttcagttagtaagcttctcccatgaaatgtcctcatggaattgttatggaataaaataattgtttttgtctaaaactatagatgatcaaataatatagttattttttatctgaacggaattattattagcatgaaataatggatgaccaaattattattagcatgatacattgaagacactcagataaaaatattgagaaaaaaaatatttgttaatcaagttggaccggtcaattaaaagacaaataaatgacttagatgcattttaaaaaagacagaaaattttgtaaaagaaactgacatgtggcatagtaacaagggaagatttttattatatagtaatagaatagattcctgagtatacattaacataatctatagcaatctataccgttcatatattttatattctatccaacggtaataactatattactcacccatgaaccacttttaacgtaggttaaaatttgttgcctcaccggtgagccacgtgatatgtaagggttcatggtagaattcacaatttataaattttgtctaggagctttccttcaagcatgtctatgacagggtaacatgcgtgttgatgatgggattacaaagtatgaatcctcacctcatgaagaaatgcagattatggactcttgtccatcctttctttttgacatg

SEQ ID NO: 6282 - DNA, 1300 bp, Glycine max
  Soy_ogl_1652 Gm05:32099001..32100300 Cluster 27
tatgtgaaataataggagtgagaattataatattgataaatataatctagttatatagaatcgatgatttgattataaccaagttttaaatggtttttttttttaccattttaggtatattaaactattaatggttgagtctatctgatgttgacctctttggccctcctccataccccaagtttgctcttggggaaaaatgtgcaaggggaaagtttagtattctgtggttttacttccccgacacgatcgaattaattggtagagattgatgatgtttgtgaatgaaagtgacacgaaagtgggcatgcatcacttccagggtaatgtaattcaaagagatgtaaccctttggtctcggttttgaactgataattaatgcatcatttggctgactgcaactaaatttcaggagctttttgtcaagagtcaagttgatcaatagaatgcaatcgagctagatggcgccatatatgtttaacttcaagtaattgtcggatataattttcaaagacaacgtctttcctgcacttgatggcattcactcaatggctaatcacttcgctctcatggacaaggttttaaattgcaatcgtgaaattttaaaaaccataatatttaaaaaatgtaaataaatgtgactgcaattacagctggtatcagttatgcgtatgtatgaagttgttttagtttcactaaaggtcatgagtttaagatttgaattttgcaactcttataatgattgtatttagattgttaaatatttaaaggaagaattttattgtttataataattgtattgagtttaaaaaaaatacatctaatgaaaaagcatgtgatcgatctagacaaaaaaagatggtatatgatttcaaaaatcccaaaagcttgagtctgcaatttaaaccctagctctagtgtacggacttaatcatgcatgtaagttagtcacttggtattaattaaggattttgttcattccttgtctgcaattttatgcacatcactgataaccagggacattgatgattaggataatttcagcatctttgaaaattatcatcctgcattttacattgtttgccatattcattgaactctctcactccatgcctgtgaggacaaacaagctatcgagcaattcaacaatataatgcaatcgcatatcatttcacagacaattatgttatcatcaaattgtatactcgactttacagtagggtcattttttggatttgtccatatataactcctccttccccagtccccaccccaaaaagaagataagggaggaaattta

SEQ ID NO: 6283 - DNA, 1062 bp, Glycine max
  Soy_ogl_3471 Gm10:40332939..40334000 Cluster 27
aagttcttcttaggtggttatatgctgctcattttctgcattcaatcatgcaactaacacactaaggttgtatgtgtatttataaggttctagtatattatgtataaacctaacttctaaaagtagcaagtagccttatctgtcaatcaagagccatactgaaaaagcaacaccgctggattgccatattgccaaattcatccaaaaaacttgcttgattgagtatagcagataggggaccaagtcaagaaattttgggcccacttattacctttttgtgtcatccatatccaggaggttatggaaaagagaaagataggaatctttcattggcctttgtgtggataaagatgatcatttatattatctccatttttgtcatgaagcttgttcttgtttgctaggtgcctatatgggaaaaaagtaataggagcatacgatttgatattgacccatgacaagttggaatccctaaaataaagggatggtgagagggttaatagtggatcgcatttaaatttcatggccacaagtatcatatataatgtaggacataatatgcaaaaacagtgctttgttgtattacaaagcattaatctgtgttaagcgaattaatcttattatggataaagtttatgacaagacgtttccttttgatttcaatttcggatcattgcttgaacttttttttctttattaattatgctttaaaccaaaaggcttgtttgcagcaaatgaattagatttagataacctttttagagaacacattattttaatgtttctttttttatgatatttaacctttctctagtatgcgtgaataattaattgagacatatattacctttgagcgagatttgtttcatgattgagcaatacttctctacttttgcaacatgccaggtacataatacgaagcatccatgcaaagaaaagtcagaaaaattgtttatgtaagtatcataagtaaatatgggcttatgttatgggaatataaagcttcaaagtttgaaggatactaattttgaaaagcgaggtaacatcacgtatgaatgtgcg

SEQ ID NO: 6284 - DNA, 1300 bp, Glycine max
  Soy_ogl_4305 Gm13:27370501..27371800 Cluster 27
attcttgatgatcaatcaatattcaatggtgcttcggatctgggcccgaaggactaagacgattggtcttatatttgacaatctcctttcctttgagtttgagtcctgaaacaactatggcaattccgtcagcactcaatgtaaaatctgatttggtggtgcttctttcaaaggatgaagggagagaacgttgttcagagattacaataattgacaacaagaccaagattgtgcacaaccagaactttgacattgccattgaggagcttttggagttgcaaaatatatagtaactttggatcttggtgcagggctccgaggcaaaactatgcatatttataggccaaaattgtaatcacaatgacaatatgatacagcatatgttgtcattataaatgtaatagttagccaataggttaaaaaattgttaattagaggttcatatgcgtatgatgaaacaaaggtttcaaatcaaattttgtctcttctaattctccaatagttgatgttaatgaatttggtcatgttttggtttggatgaacctaaattaccaaaacaaacctaagttatctctaactgggagttaaaaattagtccttcagagcattgagatttgtttaaaaatttgatattttttaaataaatatttttctatacacccatttacaaatcagatttcaaattatatacttaaaacaatactatatgattatctctatcaaccatatcatactatattaataacatacttagaaaagttttgtacctttttaaatccccactatgtacaagaataaatggtgtatatatcttggatatcttttttctccaatctctgccaccgaccatgggttatgggcaacctactaactgggtcacccatgatttgctactcattaaaccaagaattgtacggttaaagaataaaaaatagaagaaaaattattgaaagcataatctaatgttaaaaatatatcccaccagtagttttaaataaaaaataataattatacattaactccttgaccattatctttaaggtactaatgaatagcaaaatcatacatattaaagtcacaagctctgagagatgttcggtccttttttaggtgtacctagtattttaggtcactcactacctttcatgcccattggacactgtaaaacaagttgtcttaagttttctgttcggtttagttgcccaagcatgcttttagtgggcaatattagttctcaatagtgtatctgacaacagcgtcatataagaattacaacatacatttgttgactttgatgaag

SEQ ID NO: 6285 - DNA, 1300 bp, Glycine max
  Soy_ogl_146 Gm01:43106801..43108100 Cluster 27
tgaattatatggatactcaaaaagaatatagagtactaattatttgcgtaataagtacggctactatagtatttcagattagctcaactcaattcagatgtcttattgcgtagagtacttggcgttgaacttgtcattcaacaattaacctaaccctagggctttggctatttaaacctcatttctagaagattggagtgttgtgctggagcatactttgcgggaggctaactaattggaacaatgagcgaatttgatttgattagattatttgggacaccacccaccagctttatttattgtccctttggattttattgcattgtctctcttaaacgtgcgtgctgttaaagctagttaattaacttctgcctcaaaagttacaattattgaggcatatctataaactttgtcttttcaaacacgcatttagctcataggatgggaattgtgtaactaagcctatgtgtggaacaaaacatgatgaaaagagatcaaataaagttgaaaaaaaatattattttcctctctaattgaaagaatcttttaactaatttctgttctttaagaaaaataataaattatattaattatattaaatctgttaattaattatattattattttaaaattattctttttttatctttatatctacttaattggtaaatcacatttgaaggtggtatatgtggcaaacgagttcgaacggtcgtacaacatcaacgtcacacagtggctggagaattggcggcgacaattttaatataaagttaactaattaactaatttatcacaaggattttgtgaattgtcatctaggtatcctgaatcggttttgatgttagagggtttttcttgagtgattatccagatctggaatctgaacaatgtttccagatacaaacatttccagatttggaatcagaataacttgggatcaaacatcatcgtttcatctactatgtccttgttagtcactcggcagcaactttcgtcgttgggattcactttctaacagcggtcaagcccgagtctatcacacatgacaaatccccgtcctttctcttcgaccttcaaaacgaacacgagaaaaagaatgataaaatccatgaaccgaaatgttgctctcacacgcatcaaatttcgttattttatcttcaacgagccacaaacaccttctgcaccacaattgctgtttataatttagggttaaaatggtaaaaaaaaatatttttaatgaaacaaatattctgttagtacctttcaatttgtaccatccaattattttattttatat

SEQ ID NO: 6286 - DNA, 1200 bp, Glycine max
  Soy_ogl_170 Gm01:45279301..45280500 Cluster 27
aaaaaatgacgttcatgttagtgtaagcagtttactttttgttctccttacggtaggaatgttttttttttttaatgtgatatgaatggacttatttttaaaccattatcgagactaaaaagtactacagaaataatcaattttgtttgaagtattaaaaactaaacaattgcttcctgtcaaaaacttgttaatttgttgaggtgatatattaaactgaaaccattagataataaaataatgtttaactaaaataagtaaaaaagagagtagattatattattatttttattagacggtaaataaagtaatcaatataaacccaaaaaaatatccatgtgtaaatcatataatgaagtgcttattattcaccaaaactatttcttcgttccaaaaaagtgtatgataaatgtttttaattatgaaacattcgggacccttcaaattcaatatttgtaaatgctattgaatatttaaatgtgagatgcaaatagatgccttttggcccttgcacctctataaaagcataagtttgagtactccatatagttcagtcattttcacttaagataaatggtcagagttccttcgaataatgttaatgtgattgagttaagctttttaatttttttagactgttgttcgtgaaagttcttgaaaactatacgtttttgttatttatattaatatgatgatttttgtattttgtaggggcaaactaacatgattgcaacccgacccttagcatactcctcattttatctcttgatcaagtctaacagtgtaattactaaagtcttcattaaccacttaattgaataatcttatggttttattgaatttttgtccttccatcctatgtctatcaaatgtacaaggaagatatgtccaccactgtgttgctcacaaagtaagtcaagtttgaattcaaagtttcgttggccaaattcgatacaattgggtttttctaaaatggatctgataatctattaaagcattaaaatttacctatcagagcttggattttatttaaatacacatctggtagcaaatttctattaagagtcgctcagatcaatcaaactaaaaatttctctttcaaaaaaccaaaacaggtattgtattttcattcttatgtttttaatgacctatgatttatgcaaagtttattttaattactccattagtgtctaaatagga

SEQ ID NO: 6287 - DNA, 1000 bp, Glycine max
  Soy_ogl_3885 Gm11:29678401..29679400 Cluster 27
taaaaacattataattataaacaaatttaatgttattaactaaattaaatattgcttaataagtataaattaatcaactatatcttataattaaggacaagtgagtatgttgcttgttaatttaacatgtatatatacaaatgttttattatttaaggtgtatagcaaattagcaatattatttaataagctatttcatccaaggaatgtgaggccgaatagaggactatcaagaagcgtaacaggattacctagtctattataagctatttcatcccacttcaaagtttgggggcatatgtgtactacttgaacttagcaaacccacctgagggatgttcgatcgagtatatcagagtacttgttcaggagttaagactaatgtactatacgctttcaacttgcttcatagtttatgggcgtatgcattacttggactcggcacgttacctatggaatgtttgtccgagtagatagtttggccaaccaaatagggactttagccactacaaagaaggaaacttcatctttgtgatcctcactatcattaatgacacttatatcatgtaactatgttggtggacctaaaaatcattatttatcccctcataggaacactaggtaatttggtatgatttctaaccctaatctatatatttttcttttatttgtgtcgttaatttgaacatcaaaatgtcattataagtacccacgcaatgcacagaaaaaacataggaggaagaaccacaataagagattttatcaaatttggtaaaaatattacttaatttgtttttttagtatctaattccaatagttcttttgaattttaaatttaaatgtctttaaatttttatgtgattattgttttcttataatattcaccttttttaagtacatatatacatatatggtggtcgggtcacgggtgtcgatgcgtttggatattccttaacaaagtttaatgttaatttgtatttaggatattccttatcaaagt

SEQ ID NO: 6288 - DNA, 1549 bp, Glycine max
  Soy_ogl_4750 Gm14:29403752..29405300 Cluster 27
aaatataaaatttgttaagagtctgcaagcaatgactcaagaagagtgtggcatgttcttggaaggttagaaactagagccatgtgtttcttttcgtaaaaaatgttaagatattatttaatatatattattatttgttttgatgcacttgtatttaggattgggcaatccatgatccaaattacggattatccaaatcataatgcacttgagtacaccaaaggaaatagtgaagtgggttggataattaccagagtgccatcatccttttgccttgtgggccataattaactaagatgctttgtaagaagatccaagagaagtgaagcgttctgaagatgatttacttctgcgtttttttttttgtcttttcgtaccttttattgtattttggaaaccaattttcgaaggaaaaaaaaaacaggttacactgtcagtaccgaaaggtgaaatgaaagcccaacattttatgcataaactaagcctgagctggaccaagaaaaaatatagctaaactaaaagaaaaaaattatcaattttagttataatcagttatatatataattatacaatcaaataatcagttatatacaatcaaataattgttcaacgcatttctatttacacatctctttgagattgtgcggatcagtgatcaaataatcagttatatacaatcaaactttttttttcaaggtagtgattgaaacttgaaaggattaaaaagaaaagaaaggtgggataattattactagcggttgattgcatgtcagaaaagttatatgtatttaatattatttataaaaaaaatctatcaattttaactcccttggagaaattttaaagtctgagcatttttggagaaattataaggcgacaaataatctaacaaaatagtaatgatcctcaactcaactcaactccgtctcaaactaccagtcttcgcgacttgcatattgacttcaactttgcaaactgttttgaccgtttgatatgcaaattttactatgactctttgattttttgttacaatacaatttgtgtttgagaaaaactaaagttcacttttatagtatggcaaaaaaaaaatctttattttgtatgattctactttaaatatttatttgataatactactctcacactacaaaaaatttccttcttcgaaaacaaaatcatattaccagcattgtttttgtacatatacatatatcggaaagaacataaaataattttttttctttatacaaaaaatgtgggaaaaattctaaaatttgaaatacttttttctctatgcttatatgcaagtaattggatgccttgtacaacttgttaaggtgtgacatttcatgcatagactagtacacacgagatgtacgtattaagtcaattaatattacaaatacttatataaaatatttatattacataaatatttatgttttaaaattaatatatcacttaatatagcaacgatgtatattatttgtacatgaatctctttaatgtctctctcacatctcattgatcttttgccggaaagtcttgg

SEQ ID NO: 6289 - DNA, 1600 bp, Glycine max
  Soy_ogl_6694 Gm20:2458301..2459900 Cluster 27
aacggccttgacttgattattgtgagttaactttattggcaagttatacataaggtctcaatgaaacttgcggcatattcctacgatagattaagcaattaacttcccatagttcatgcatgcatctagcttgtataggttatagtacgaagaaacccccacgtggtaagcattatgaacagtatggtcaattatagatataagaaattaaggtgagcttcaattgaacattgaacagtgctaattaatggttattattttcttcccaggatcaataatcaagcatgcatgcttacagcacgcaattgacttaccactatttgggatttgtcttcaacaaaaagtaacacattctttcggtaacgacacctaacccacttcgatcgactcctaccttgaacagtgatgaagatctattgtacttgtttacaagtgctgcaagtgttacgaattccaagaattgacaaaaaaaagtgtacgtgtgaattaatacatgagaaacatgcatctgtgtatatgtaatatccccccaaataaatgacttctattttgattttgtgactcaaattccatttttattggtaacattgggtagagatcttgacgaggttccttgaaattcaaaacctagcaaaaaccaacatggagattgattgaaaaaatcaaacatgcataaatgatatttcctacaaaataattttagtatgaaaagggataaaaaggatagactgacaaacaagaatatgcatgaccatacacggatagatgaataaaagttaattgaagaaaaaaatcagacagtgtttaattgaagaaaattacattcaatacttttttatttattttattttatatgaacataattatatttagttttgatgcgcacgtaaaaaagaaattcaaatcaatcttcaccattaaagaatattataatataatagtgttaaaaaatttgtacacaagaattaaaacaaaatttaatagtgactaatgttaagtttgtacaagtgaaattaggtttgaatatcttaagtaagattttatgattgaattttagatagaaaaaatgtaattgaaaaaggattgaacaggctatataattttttgtgtaatgattaaaacaaaattggccaaactaattaaaaaaggaatttcgatctgctctttacttctatcaattaaaattcttttcctttgagcaaattatgaaaaatcagcgtggacaatccatagagtcacactgttcatactatttatcaactttcaaaatcaaaatagtggcaagtcataatcaagtcttgaattgaagcatatatacgagatatgttatgcatatatcataaatgaattttgatgaacacttatcaagggaaaacatgggtgcaattgaacttccgaagatcatgtgtccaaacctataatatatagactagtgctatatttgcgagctactgagctagtcaacgaaaatcacatggctccacaaactataattgccttaaacaaggaaccctgaaacaagcttgcgtatgtacgtatagtatcaatttgaacgccaacaaaacgattatacacacaagaattttgatgtgatcgatgt

SEQ ID NO: 6290 - DNA, 1104 bp, Glycine max
  Soy_ogl_3881 Gm11:18803677..18804780 Cluster 27
cacgttgcactgatacgaatatgagatgcagtagttttaagtctaaggtatgagtacatcattttttttcctgcattccacaaaaaaaaaaaagtacatcattttttttaacaatatttaacaataattttttacgagctaccgattccgagagtatgaaattataaaattcatcaactttctcaaaccttgcatgcccgccgcattcgcaaataaaaaaaaaaagtaattaaaagaaacgatgtcatcacaaacaatagctcatatatataaatatacttatacaacttaatcattttctccgaaaaaaaataaacttaattttaatttcttgggtcgaataaagttaagacttcaaaatgctcatgttcatctctggcagagttgtctaaccccaactccatccattggatattataaaataatgtaagagaggaaaaaaaaactaataccatagcatcttatatattttatgtattactagagtcgcatagcaaagtttatatatataaagctttataacagatggttaaactgcattcataggattaaatttttggttttaggatgagtcatatatatattcaaagaagactatcattgtgcagatcgtgttactaattttgttattgataataggcattttttttttttgtggaactctgttccttcattttgttctcttgactatgcctgtgatattagagggcagcctcagtataggatcacttctcattagcctggattttggcctagccccctcaggttgttctgtctttttttcttttgtttttttttgccatctataaagttaagctggtttgggtggtggattctttgcgcttaggatgccaatctagttggaatgttagattgaatctaactatttcttccatcattttttttttaaaaatattcacaatgcaaaaatgatagtactacattatttttgtaacgaataagaagagaaaattaatccaaacaaattgcttgaccaattatgacaaatgcttctcaagttgcaaaggaaacaaggagggaataataatatgattatgaagatcagataattgtttcttgttaggtcccccaccagatccccat

SEQ ID NO: 6291 - DNA, 1000 bp, Glycine max
  Soy_ogl_5706 Gm17:19428101..19429100 Cluster 27
aaactttttgcttttataatatttaagaggtggaagcattgacaagtgtaagaatataaaatataatgtaataaataaataatcagcgcacccatgactactatatgaatctaccttgattaatcaaattaggaaatcatgttgaagagggtttcaaagttgagtcaaaagcagcttggtctcactgtccctaccacttgaatatgtaacccaaccagtcattttggtaaccaatatatcaatatatattttataaaggagtattattcttagaaaccaatatgttaatctatatttatagagaaaaagaaataatagaaaaaagtgataaatataataagcattcaaatgttacataaaaataaaaatgaaaaatgaaaaagcattcaaatgtgacaagaagagacaaatagaaacaaataaaaggaattaatggaattttttgaaatattgaaatgtctaaattccattacccttccataaaacaagcctaacaaacaaaaggaataaattaacatttagccgtgggagagtcatatgcaaaatgttgactcccggaactggggaacaaccctcacttgtatgcccacttactcaattaatcaactcatttatgtacgaaaaagtaatatgacaaataaatttaatgagattaccatagatcttaattttctttaaaaaaaaaaagagacttaattatgaataaatcttaaatttgtcttgctacttaaccaactagaccgctttaaatggaaataatttagttttttatttgagaaaccagaagcaaaatgcattagggatttaggatcgttggtctatgatagctacgtactggcccactgcctagtgcctaggcacattgctctagtgcgcaagcgttgagcggtgtttattcaattatttttaatattaaactagtttgttcttatattttttatttattagtaaactagtttattcttatggtggtgttgtgagactttttttttaaggctta

SEQ ID NO: 6292 - DNA, 1400 bp, Glycine max
  Soy_ogl_5642 Gm17:12008101..12009500 Cluster 27
ccctaaaaaattgggactagtagatcttcttggagtcttatgcacattcttataagtgtgacattattttgcgtaatgaattctttaaagttgtagctcatccatgtgtagtccttttctagcttaagctaaagacttttgagccttttttctgtactatacttgaacaagggcaatgttttgcaaagccttaaaaatatagcattccaaaggaaacaactaaataaagatcattagttggatgtgaaagagatgttgtttgaagccatgccatgaaggctaagaatgagaaactatattgtcgtgcattcttaggctatctattagaggatacccttattttgttagataacctcttttcttgttggccgattcaagaagcaccttgaaaaagttctcatgttgtcccttgacatgatatttacttaatcaaatctaactgtgaaattaaataaaatgcaccaagatttgcggtcgccgactgcgacctacgtccagtatatacctaagttgtaattgagagtttttcactatttgatcaaagatataacacatcaagcctttgacactcaaggaacccaatcccgtatgctcctcaccttgcaaactgagagaaccctaactcgcagaaagtaggaaaaacctttttcctagaaccaccaagggaaaactactctatatcacaaataagcaagtcaaaggccttaatcactcttatagtgctctatgactcacatccttaactaagcactgacttaagagaaaacacaaatgcccatattttcactttcttgttagtttgttaatgaaaaactttgctcttttataagagctttatatataaggtctatcaatttcacaaatcataatagatacaagataagattttttttaaaatccaaattaaacatgtcctagtttggttgttgggaattgattcattttcttgggaaccgattccttgcgagaaatcaatgttcaaaaattgattccagatttcaagacttgattcttttgcataaaattgattcatacatatataggagaatcgattccttgactctagctttttcgagacttgacttaaactcttttttgtttttaattatttttactcttttagaaaaccttatttaatgtgcaatactcattttaaccccatgagccaaacttagctaagattagtgtttggctttagcttcataaaaacaatttgaacttcaacagtgaaaggtcatgtttaacatctctaactgtgaaatattatagatagtaccatgaactgatagagatattctacatcaggcatagaaaatacgatgaagtgtaagtccaacaatttgacaattacttaggagaccttgaataacccttcaatctgacaacaataataatttaga

SEQ ID NO: 6293 - DNA, 1182 bp, Glycine max
  Soy_ogl_451 Gm02:9138401..9139582 Cluster 27
ctagcatccactttaacctttaaattgtttagttccccgttaagtagtcaattatactgttatggtcgtttatttacttcttacttattggtgtagcaaatagctcatttttttattaactatttggagggtgttgataggacaactatataggcaattagtatatataacattaaacttttgaaccatgttagtctagataaattattagttgaaattgtataccactataccatttatataactttttaattgactaaactcatcataggagttaagaaaaggtcttcctgctttctctctgtgtacaggcttgtaggttcaagttactctttcacaaatattttcaagaatctatttgtttattataagtcataaagtgttacattgttggtaaacatgggtgtgcatataaatgagtttgaatcatttgaactatttttgaactaaattagtttggttaaataaaattgaattgattttaaaattatttattgttctaaaatcagaatggttgttttaaagaagaaaaataataatttgtaaattagatcgaaattagttccattcttaaaaccgatttaaaattgatttgaaatcaatttgacctcccaattagaccaattctcaaatttgatttaaaagtcgaagcgtttaaactaaattgaaaccgattcgttttgtttgtttttttttttttttgagaataattttttgcacgcccctagtgataatattacaatttgtttgtttttatgttcaaaatgtgcccaaaggaacattttatcttatctaacccaacacaaatttcttgcttgagaaaattgtgacaacaataagccaaacacatacttagctattgaaccaaaaatgagtgttttggttcatagattaaatgatatgagcaaatgaagatttggtagtgggtgaaattttgaaccataataattgtttaaatttgtatacaaattaattcctattataactgaatccataatatgttaagcgtgcactttacaaattactcataataaataatggtttaaaactcggaccgaatcgaccatcggactgggtcttgcacaatgaaaggacaccagccagaatccaattttgatcctttggcgactttgggacgaggattaccatctatgctacaccaacttcttattatataactgc

SEQ ID NO: 6294 - DNA, 1000 bp, Glycine max
  Soy_ogl_130 Gm01:40069801..40070800 Cluster 27
tgatgacaaatcaataggaacaaggaagggtacgcattggacttccaggaggggaaggacttcttggagtttcccaaccactaacttcttgtaaaagaagtctacaattagatgctgccacttcacagcttgatcttcagcatagcgtctatcatccagagcttgagcaaatgctttcctcgttctaagcaactcaagctcaattctgctaacatactcacttgatggagggggatcatacacttcaagtgcaagagcatcaggatcatcagtagcttcaaattcagaatcaacttccttaatgttaggtgcaacatgatgggtgaagatgacgctggagtatggtagatacacaatgaatgagaaagtgcgatcagacacagcacaaaacaacatgacccatgaacataccatgttgaaaagtgtttcttgagtgaaacaagtgtgattcgaagtctgatagcaatgtccattcttaatgttaggttccaaactagagcagtttcagtctgtagaacctcttcatggcaaaccaatccagacttgtatgccctatcttcttcttgagagccttaaactcatgtttaaagagccttcttcagcaagccttcacagatttggttggtggatcatcttcttcatcatcaataagcaactcctagcttttatagcagttagccttttggtgcaacacaagattatccattgctatatggaactaagtgtttggagtggctatgcgacaaaattaggaaccaagcgtaaaagataaatgagtattaaacctttccaaatgccttaagaggttagaaagtttaattaactactgactaaatctaacaaaataaaactatatttttaactgataacttcctaattatctccaattgggaagaatgctgatggactgaggtattattatgttctaatttagttaagaaataccttcaaattaatctttataaaacatgaacaatattttcaattatttattagtttt

SEQ ID NO: 6295 - DNA, 1239 bp, Glycine max
  Soy_ogl_152 Gm01:43511101..43512339 Cluster 27
agcatcggtttcaaacattatttattcttcacaaactgctagaatttggagttgatcgagtaatctgacttcatggctttcataaaaaaggcactagttatggtttcttgccgcttccactgcggcttaatcctaattcttatgtgttataaaaaaaaaatgatagtttcttatgacattaggaagaggggtagggtggatactttctttcagaaaccgggtaatactaatcagtgccttaaagacattagttaaagaacctaaagcagatatgttattaaaaggagaaaattacgttgcttataatatttttttatgttgtcctataatatacataataaatattgtccctttttagtttcttaattgatgtcctgaggacattcattaccaaaactcttttttttatattaatatcactaggggtgtatagtattttttatgatcccaacttagagagtttttatattaagtctatccgtgatctctaagtccatccgagagtctttggttgattcaaaatggatctagcccagtctaggtggttaggatgaaagactaatcctaatcactgtgtaaaattacatgtgggccacgggaattttagtttggcaaagagagtttttggtttattcattttttgtttttcttttgcttttgcccacttttgggctgggcctagtgctagtttccactaactttgtggctaaaacttcttgcactcccaatattacttccttgcgtctcattacattagggcacaacaggaagtaatagtgatagacgatagtgcagaatgtaacatcctaactttgtatgtgtaacttctaagttaacgggctcaactggttagagcagcccgtcaagcagcaactagattatgtgacagacttttgctctttagactgtcggaattactaagtacatctcctacgcacctagactgggctagatccattgtgaatcaaatttgatccttgcttttattttaatggattatttgttatttatactctccattttaataataaacctccttttatcatttttcttccaaaaacacccttttgttatttatacccctttggtagagacccctctggagtttcttccccatttcaccttatccataccaggctctttctcgcatccattaagaagattgttggtccttctctcacgggaaaaattgcacctgctgtcatatatgaacggttaacgtaaacccttctttgccat

SEQ ID NO: 6296 - DNA, 1300 bp, Glycine max
  Soy_ogl_2040 Gm06:38992401..38993700 Cluster 27
agcattaagtactggcagagtaatatgaaaaagcaaaaatgatggtagaagtgcttggaggtttaggcgagaaaaaatgctagcagacgtaactgaatttatatatgttaagacgactttgcatgtgtgacaagttacacaatagatggcctatcttgataattctccttttgtcattgttttaactccaaagtcactgtgaaatatgaatatcaaagtgatatacaaacatttcacagatggacatttagtaaaggcttgtttggataattattcttaattacttatagaaacagaagcaaaatcaattaaaaaaaatcaataacttaaagttatgaacttaatatagaaatgttttcatctaactattccaagaattgaatctattttttttaattcattttacttcttgtttattttctttgttacatttaggtcctcggggtagggtgatggaatgcgatatggagataacaaaaattcaaaaattgaaatcttaccatatttttttacagcatctcacatattgagctatccaacacatacatacagttaatgtaaacttttgggtccacattggagaaaggtaacttggatcctaccacttggcaattgattgttgcatccgattttttttcacttcttacaccctcaaatgttttaatattatcatattatcctccctttatcacgaaatggcttttctagattacctatgcacttccatttacctatttaaaaatataaaaatcatattccaaaatagctattatgaaagtgtattggtattccataaaatcatagtttaaaatagctattccataatagggtttggtgaggaaggaaaaccatgatggtgaaaggcgtgagattggcactatcttttgtctttggtgcaatcatcatcatgatgttgtttaatgtctacctacatttttgctcccaaaactacagggaggtggctatcattgtcactagtgatggcataaacaaccaagaagcaattgataaatgttccacctttgtttactcaatggtgaaggagcttgaaccgaagaagaacatggtagtggagtgcgcaatgtgcttgagcgattatgaagagtgcaacatggtaaacaacataagaccaaagtgcgacgtggtagacaacatggttgtggacaaattcactactgcgaggtttcttgaatctaaacaaaacactcttcaaacttgttcaagcacattaaggactctactatcgagttcttctccatttcaagatccctgatcatcgagtgaaccaaagtgaattatc

SEQ ID NO: 6297 - DNA, 1200 bp, Glycine max
  Soy_ogl_5076 Gm15:20682401..20683600 Cluster 27
aaaacataattcataaaagtccatttcataccatcgtaggcctttgacaaatctagtttgataacaaagtaacctgttttgccccatacattcctcaaattacagagaagttcttgagcaacaacaatattctcgtgaatgctccgagtttgaatgaaactcatctgaaaaggggagatcaattgaggtataagagatttggctctccttgtaaattgcggtccaacctatccaaaaaaggattatgaaagccattatgcttttgattttggataccttcaacacgagccaacaattttcttttcttcactttaatttctccaaaaatatcccattgtcatagagaaaggttccttgcaagttagaaatattaggcacaaaaggggcattagatttccatgcagaggtaaccacatcattgaaggaataatgagttaaccatgcacattcaaatttaaaagcctaagatatgtctccctttcaaaaccatgaagagctataaggattggatgatggtctgaaaattcaagtctaggcaaaaccttaaccactgcatgcatcaggaaatagaagcctccacaaatcattgttcaacgccctatctagcctctcaaacatttgttgaagaccatatattgaactgtggtcctctctaagtgaaagagggccccccaccttagattgttgtatcctggattgcgaggctggtgattgtgttattttagcatttttttttttatttattctggtgtggacatgtctaccgtagtttcacacatatctaaaaaaaaaccaaaatcctgcgcaccagctttgtttctcacggtgggggatttattcatgccccccaccttagaagccgccctttgacatattgcttacttaaatgaaagaaagctctattagcagcacctctccaattccaaataaaaatatcggaactcttatttaccatcatcataaacaagcaattgagactgataacttgtaaccccttcaactaaggggggtctccatatataaccacttccatatcaagagatccatgattcctatcactcgaattccaaccaagaattttttttatcaacaaacaaatgttaattgtaggtttgttaattttattttgtaaaagaatcaagcccgtaatcttttttctctttttttttcttctgttttaatcatccaactaacattcta

SEQ ID NO: 6298 - DNA, 1083 bp, Glycine max
  Soy_ogl_6104 Gm18:48396718..48397800 Cluster 27
taaggattttatggatttgtcaagagagacacgaacctaactccctaaatgttgtagtcttaggatatgccctaatgaagagcaacattgagggaggaagtggtacttgacgatggtgttttacagggacggactttccagagatggaggcatataatggggggaagtgattacgctggaagcaaaagaggaagatccgtattgtggtgacgaagttgtcgatgcaaaaagggttgaagacagagcaacatgtgcgatagtggagggtgcattgaggggaggtgctttatggtagtgtagaagtcatactttgagacaataatgtttagggagtcctgctttgtgtttcccttgatatattcatacaacctttatttatgcttctaaaatgtaaatgtcaaaaagttttataacacttacggaaatcagtttcccaaagtgttaaaatgttaacacttcccaaaatttaattcccagaaaggggacattttgagaaaaaaaaaatacaaaaaggagatatatttagcaaataagggagctacatttagcaattttcgttataaaggaacaaacttttttattgttatcgtgatgtcagtctagaacaaacatcttgtagcaagagtaatgtttgatgaagtccaaccataatttatcattttaaaaatcttgtcgtttgtattttgttttaactataaaaatccaagaatagtattttatgttcatgttattgctttactctattttatttcaacaaatcattaaatttttttacacttcacggttgatacattcgtgattttggacagtaattttgtgaatcttgtcgagcatgcataagtccttgagggaacaatactcaatttatcactttgacaacatgaatgattttttacacttgtcaaggagacaacaagtgtgctaagttaggggaaattgttttaaactagactaaagaccaaattcgtatgagtgggccactttatcccaatgaattgccacaatcaaaattatgtgtcaatcacagtcatgtttgagcgtagattcttagatgcattcattagattgtatgctaaaccatag

SEQ ID NO: 6299 - DNA, 1100 bp, Glycine max
  Soy_ogl_6129 Gm18:51643101..51644200 Cluster 27
ggaatttgaaatctaaaattacattttagcagggtctttaaaatgtaaaaaattgcatgtcaaaaagacttttccaaaatataattataaatttcaaattaggtgcaagaagcaattggggagtgcaggaagtaattgtccacattgaatcaggtgaaatttgctgggccagtgatttagaaattgtttctttattcaatagttaatttttcatccaaaatctattaatttttgaaaattatttctgaaacaaatattttaaaacccagaaaacagaaacaataaggagatgtttgttcatctttttcctttgacttggtatggaaaggtaaaggacaatgcctcaacctaacgaaacaagttactgaagttaccacaaattaacatttttgtccaaccttaattttggatagtttaatattgtagaattcagtttgattaaaagcaaataaattgatttagtaaaagtaattttttttacatatgttgataataatcacttaattttagacgcgcaattataaaaaatatatagaaatattattaaagtataaagtaatactattatattaagttagaaatatttgttaagacacacgcataatgtcctaaatgtggggttcagggcttctccattaactgaaatttttcagttggatatagacattggccattgggttgtgggacccacatgctctcaccgtcaaccactttccctcgtcgtttccctccttctttcacaagcttgaagcttcttctcactcccaaaactttcccgcggggaagccctcaagctccttcctctattttaaatttcatataaacttgcagatctggttttgattttgttgaattcccatcagagaattctcaatctcattcttctatttcttatctttttttttaaatcaatatgaaaaactggtttcattttgtagctcaattttatgagagcgtgaggtacgatgggtttgttgcacaagagcgatttgtgcatgggatgatacacgaggatggagacaaaaccaatctagaacgaaagggtgtgaacgatagcagaccttcattcgatctcaagcacaccagctatagaccccaat

SEQ ID NO: 6300 - DNA, 1500 bp, Glycine max
  Soy_ogl_6038 Gm18:14494301..14495800 Cluster 27
attccaactactacccctagagatctgtttgtcattattgtgattaaaactcaaccaatcatcatatccaagactcatgaatttgggtcataactcctggtctagaatttgcatccagaattgctgactgatgtcacagtcacgcaatatatggataatggtttaaggagctatcatatgccttttctttcgttcggtgttggtaagaagtctatgatgagctaatttccaaaggaaaactctaatttgttggggactgttccaattccacaaaagattagaattatgcatcgtaggattcttaagagtgtcctcattagataggctgccttgatagagaaacccttatcattagagtggcaccaaatgggggtgtctccacaatagggatggtatatggtatcatagcctggagggaaggggttcccgagatctattttctagcccagaacctcacacagaggccatcattgaccacctatctaacactggattcaatcgaaggccacatttaagcaatacccttccaaatatgagacgtgaaagttcttcttgtaacccttgggaatagccatagatcctgcagaatacttagtacgaagaattctcagctacagagcatctctatcaactatgagttgccaagaaagcttgagaatataacacttattcagaagataaacattacgaaagccaaggccgagcaccttatccttgggtttacaaatgtcctcccaaaagatgaggtgaacttttcttcgatcatgggtgcttccccaaatgaaatattggcaaagattttcaatatctttgcaagcagatgctgggagaggagtgatctgcatgatataagcgaggatgctcagaagagatgattgtggcaaggttactctacctgctaaggagaggttgcgagatttccatcccgagagccttttcttgatcttgtcaatcatagaactaaagtggacaactgattttctttgattaagaatggggaaacccaaataagaatcgaagttagtcgtactgagaatattaagggttgcactaatagaagatctcaaagtatgatccacacttttggagaaaagagccgtggacttttgtttattgatcttctacctagaagctagacaaaaattgtctaagatccttttgacttcagcaacttgctggagggaagcctcaacaaccaaaatgatgtcatcggaaaaaaaaaaaaagagaaattgggatcccatttggttttgccaaaaatcaaaggtttccataagcctttattaatagagtcttgaataagatggcccaggcgctcaagacatagaacaaaaaaagacatagtttgtctaccattccaattaatagaaaggaaagataagttgatacaatggtaaacaatctccaccatttagtgaggaataccaaccaaaagcagagtttccatgacaaaatctcactccaacatgtcatacgccagggaggaggagctaatacaat

SEQ ID NO: 6301 - DNA, 1113 bp, Glycine max
  Soy_ogl_2048 Gm06:41269188..41270300 Cluster 27
cgattaagaaaatgtattttaacaaatattattcttaaatatctatggttacttgcatatatttgtgttcgcgtccggattccaaagaccttaaaattagaagttctgatctaaaatttgtgtgaacttaaggtgacaaaattaagaaacattataagtttattataagcttataatgttattgaaccaaaagtctagagcctaatcatcctaggttgaaaaaatatcattagaccaaattatcctatcattaacaacctacttatgattgatactcagtcgacttaccttctgatcagatggtctaatttgtaaaatctatagatatacccgcttaataacatatacctctacgggtatttgtggtgggttggtgtatattttcatccaagcaatgagggatattgcatgctttgcccaatcctcattttccaccatttgccaggcctatatataccttaattagattcaacattgtgagctttatattcattttagttttcatctttggaatgtgctctctttctgactttttaattaaagtctttacaagtgaattctttaccgctcccttcattggaaatcctacggttgctatggatcgcttctccaagtccaccatgatgtaaaacatctctttcaatatccctccctcaagatggatcctctatgctccaccattggttccatctcaccaaagcacacgatcaaagttcatgtatatattaatatataggtgaaactttatttttcccttccattttcagcaaaccacactatcaatagctcaattcatgcatgcagcaaattaattagatctcattaatattgtgcacaccaaaaggttaagaatttatttttcaccatccattttctgatggcatgatttaaggagtagtaacttgttaggcacgtaacataaaatataaaaacctaggctttcatgatcaagtggtttaaagttcaattctttctgacctcattttttctaataaagggagttgaactccaacacgaagtaagttaatcagtgcatgatctacacatccaaagcacgtacgtacatatatggttgcgtgttatgaagagaatatgataaaattatcttaaagt

SEQ ID NO: 6302 - DNA, 1200 bp, Glycine max
  Soy_ogl_2827 Gm08:39578501..39579700 Cluster 27
ttataattaattgtgactaacaacatgatcttaaaacaacaatcccacgtattaacaacatgggtaactgaacaagaacagataaacattgaagaaaaataaaataaacagaaactgataaattgaaatcatcatctaaactgaaattttttacttattagtcaccattccagaagtgatttctttattatgggaatgtttattaacgtgcacccacaaagaaccacgatcatgtgcagtgcgttctcccccatttgacaattattatgacctttgttgttcgccaagtattgcttcttaaatcataatggattcccctactgcatgggattctcgggcactgattaagtggttgttcacccgcgaactatggccagggatgttccacatgtgtggcaactgaaggcataatttctagcccgcgcagaaaagcactcgtcatgtttcaccttcaataattattaatttacatatgtacgtacacaccaattcaaagaatgtttttaaatatagtcacaagaccttttccaaacacgccaacgctgccaaattaactacgaatttaaaaacggggttatagccaattataaaaactaaagaagtattaagttcaagtatgaaatatacaatggcaatagcatgcattgtaaaacaaaagtgttaaaagaaaaatactcaacacaaggaatggaacaacttttgttgtctcttttgattttgagggactattttctagatacattcacataaataagacagaaaataaaataaaaaaaaaacatggagaattttaaatatttacatcaacttgacttagttttggattgccttgtttgcacaatagcttagcttaactactataattatagtcttacgtatggaaaccagcaagcgtgttgatggattggtgtggagtttattcaacttttaatcggtggtcttggtttaagttttgagtatactacattacatattttattctttcataattattttacttaactcaaacataattatctttagtgaatgataattgtaatttagacaaaaaaaaagtcttacatacaaattaaaagattttagttttaattagacatttataattaagacttctagccttggtcctttatctatatataaaagaaagtaggtgaggatagtattgaaaatatatttttggctagtaaatgaatgaagaaa

SEQ ID NO: 6303 - DNA, 1100 bp, Glycine max
  Soy_ogl_3895 Gm11:32915201..32916300 Cluster 27
taaacttgttaattaaataaactatacttgtttttcttttataaagattatgacttgcaaaacatcacaaaaggacaatgacatcccaactaggttggcacttcaaagccaattgatcctatgcggcaagccaaaatttattcaaaataataaaaagaagaaacaaatccaatttgaaactaaaaggccacgattagccaacttaattatcatcatagacattaccctctctaagaatatgagaaacctcaaatctcataaacctagccaaaccaagacgattcttccaatggttttgaagcttccatggaactatatcaggattatgaaaagcgtgaacaaccaaggtcgagccacactcaagatataatctccaccaacctttttcaaaatccaattccacagttgtcatggcagttaacagttctccatgaagaacaaaagtaatgcctacgttcaaagcaaaacctcccaaaaagctactttgactatcacaaaataaaccaccactggcagcagggtcaaaagaacctgatccatcagagttgcatttaatccaaccacataaaggaggataccatgagaccggaatgattctaggcatttattcagatgacaagtaacccgaaaaaacttgagaattgagaactcgtgaatggatgaactagtcgtgcttaaggacatattttcagataaagaaacaactttaacatgattaattatgttgaacagagagaaatgaaaattatcaaatatgaccttatttccgctagtccaaatgccacaaagaatattagatatagcaaagaataccacactctttgcctgggaaccatgcattttcccacagagctgcagaatcattgacatcatgaaggaggaatcaataggaatattcaataaaagactaagccaactccataaagcttgaggtaacgtgcacgtaaagaagagatggctcgaagtctccactgggctaccacaatgagagcagagagaagccaaactcttgaattaagtgtaatttgatttataaactaatttgattctctctctaagaacaaaaaaggctaagaaatacataaatatattttctttat

SEQ ID NO: 6304 - DNA, 1000 bp, Glycine max
  Soy_ogl_5722 Gm17:33967701..33968700 Cluster 27
tattccagggatatttcaggagtatcaccgagctcctcgaccatataggtacttaaatcaaactagactaattcataataaacaaaatgaaaatgcatttgctgttgaagcaaattgtcatacattcataaaatttcccaacaaaggactcagtagatggatggatacctttttccattaggtaagtgcatcttcaagctttcccttgtctaaagttgtttttgatggctccaacagctgctttccatccgcaaatgagcatgctgcaaaggatgcattgcaaacaaagtttggatctgttaacaaatttccaagacattaaacgagagactgagagaccatataattgtcttgtcttgtttatttagttcctctttgtctcggatgatcacactagtttaatttaatcaattcattcaactcagcccccatggtttatgcctttgggtaatagtaaagaacttaacagcactgcagcatcagtaaaagatgccccaagaaagtcatcctgggatgccatgggagttttatccctcaccaccgaattaaaccccaaatgtcaagcattgtagtcaaatcaatttttagaagttgcaaaataggtaggactaagcatgaccaagtcataaactgcaagagtggaagaaaaacatgaggaaaaatagatgaaatgtgttttgattctcatagctggtttatttaacaaaacagataatatttcattggattcccatagctgatattttaaagttaaacagatgatgggtgttcaaacagagacatgcggggcattggattatcaaaatttcccaaattcggtaaaggaagcatatccttcttacaattgaaatagaaatgagatcagtttgcaaacagagagtaaacttgaaaataaaattgataaatcaatattcataaaaataactatctaaaaataactagtaattatttattcctccttgtaaattactatctgagaagctctggggttgcacccttt

SEQ ID NO: 6305 - DNA, 1100 bp, Glycine max
  Soy_ogl_6037 Gm18:13562901..13564000 Cluster 27
cgacttaaattcttgtattctactaaggtggcgtgttccttctttttttttttttaatatctcgagccacgaggaaacttaatgtaattttcaacttgatttataataagacaggcacatgtttttagttcacattaggttatacatttttctaaaaaaaattgtagttgctgtcgctaacctgaatgatgttggttatcctatttcctagcagaattcgatatagttaacaatattttattgacacagaaggatcagctaatattgaaaataaagttattagaatatgattactagtggcttccacgacatgctaaccttgaagctacgaatattccaaagtttaaatatatatgttgcacctatatgatcacctgaatgagaaatgagaattagacagataactgcgttaactttctgtacaagaacttcatggcgatttgtctcagttttgttttgaatggaaaatgtgaaggacagataactatctagattcaagtttatttctttaaccttgttacctttttcaccttttcaaatactatatggttacatctaatctaactaactactagagtggttgtgcaaacgtacatttttccttttttaacttttagttaacgcccaaattaattctcgagctttttctgtctttggaagttattttacgtattcttcttgaatcaaattttctaattattttttctggcttgtagggtgcagatttgtcccacgtattttgtgcaaaaaaaataggctactcctatcattaaaagctactgaccgagttcattgagcaccctgttttggaagaatcatttagtgttaggtgcaacttctatgtacttacaagcaacaacatctgttcaagtttcatgcaagttgctcaactaatttgttcaacaccaaatgaatatttgttgctgtaaattactatattgagtttatacaatgttgctgttgtctctcgtgtttaatacgattactaattgcttctggtcattccatattcatttaatgaaatggcttatatcaaacacacacaatagagagaatgagagagaacctattgaatgaaaatacacaaatgtttggcttaa

SEQ ID NO: 6306 - DNA, 1100 bp, Glycine max
  Soy_ogl_136 Gm01:41420501..41421600 Cluster 27
gtgagaacacaaaaatgtcctactataacttttgggcataatcattattctattctggtcatatcttcataaacattgtatgtcgtttgcacataactttaattatatcgtttgcacataactttaattatgtcgtttgcacatacctcccttttatgaatgcaaagccgtaagaggctcacatgccaagtattgccaatcacagagacaaataatatcagtgtcttattgttgctgtgtccttgtgaccttaattatcaacgtaagctaacgtttcagaattccccatcaactcaatcttcttatttcagcttaacacttatcaaattctcactcccctccaaaatcacatcacctggaaatgtattgttgcacagtcctattcctatccaaaactgctacatataacactcacccttcaacgtatccaacagctagatgaggtattcacctgcaaacgataccatgcccccacatagatacatgtgtttctcaacaccttcgcagcttctgcgaagcttcctcctttccatttaaagatatatcttgatctataacttgtcttatctctataagtaactcgttcctttcttctttttgttttttgttttcttgcatattcggtggcataacgcaggaatgcttacgtaattgaaagtacattgattatattgaagcatgtttttgtgaaatatctcaataccttgatagccaattttaaaaaatccaatatgaatcaattatgtttcaacttagttgttgtgatgagataaataattagatccacccaacaattacagtttgtgcatctatatatatgtgttactaaaaaatttatttacctttaaaaaagtgctactaacaaattaactacacataatataatataatttatcacttaacttaaattaccgatgcttattatttgattttgttttttaataaaaattttaggtaaattgaattccaagaattctcggagacaaatacatgactcgagactcaaagaatacttgagtacgtacatgcggaggcagaaaaatatagttgggggatcaatcatgagaaaggattaaaaaaatttaaaatgaaggaaaaac

SEQ ID NO: 6307 - DNA, 1000 bp, Glycine max
  Soy_ogl_584 Gm02:39900301..39901300 Cluster 27
tctaaccgattgatgtatgttttttattggtttatggacactggatacaagcctgctggcacatgcatatctgtattagatgctaagatgcttcctcttcttcagatcttattaaataaaattgagaatagggcgctggatttcattcctttactataaggaagaattaaaatttatggtttgtgtctttttttaattcatctttatcaaattttctaataacaatgctcattctggcaaatccgttttttcctttttgttcttcatcttattgttttatattaactatatatgcatgtacaatctcccgatggtataaattgctaaacaagagtattaattgtatatagttttaccattagccactcgttctaacaatatgcagagaggggttagatctagaagaacaatttattctccaaagttgaatccaattcaacttattgacaaaagttgatatacatcctgagttgtgtttttcagtaccaacattgttttccgaattgaataagttgaattggattctccgataccgcaatactgtacatgtattggatacagtaatagcagggggagtggaggtgtaattggggtttgggagtgtgggcttacaaggataatttagggtttaaaaaaaaagaaggaaagtatatatgtaaaaagggagtgaaaataacaatttcctaattttcttaagacaatggttataaggaactggatttgagtgtagtcgacaaaaaataactgctaatggctttcatcggtttgatgacaaggttaatttgcaaaatatttcattataatattatacccttattatactaacagttaaactacttaaaaatagatgtaatgtagcaaacggtatacagtgttttcatgcacccttagaacatacatcaattcgcttgtgtaccattatctattatgattcctagttcttgaatttcactcctctaaagtgagggaagtttagtatatattttaaagaataaattta

SEQ ID NO: 6308 - DNA, 1000 bp, Glycine max
  Soy_ogl_587 Gm02:40150401..40151400 Cluster 27
tttttcatgtgcaataaggaagaggtgctttgctgtttgcctgttcttaaaaatttggtggcatggagttcctaacaagctgaatcatcatcatcttcttcattgtttggcttaagggacataaaagggaaattgtaaagaaataatcatctctctccactcaatttccagcgtatttctaaactaccaaacacagtgtaaaggaacatgagaagttaccacaacatgcaaccattatctaaatccaaaatcttttccaaccctatcacttaagttgagtccatagaatgtactctgtctatttcccatttccatccagattgacataaaatattgaaaatccaaaagtcgcaatcttttttttttttttacttggcttattagtttttatgttgaaaaacagtgggtaacagagagagatgcttgaataaaatcaaactttaaaaataaaaggaaaaagtaaattttatccaaattaacttattatttgcccatgaacaaacataaacatttttattatttaaatatcacataatcatttctatttgtgaagattcgcctatagaaattattatgtgcttatcagaatacattttctacaagatcattgctaatttgtgaagattttctaaaattcttgggaggatagataagaagaatgttttccctacaccaactgtacgtattccaactgcttttccattgcagcactggagacacatcaaggcttatgactcatatacttggcagcacgctaggttcagtgcattgttatcttggttgtctacttgaagaaatgcattatctttaattaaactcctcttattcaacaagttgaaaatggttgccaatgtctgtggccaaaggaacaacaatttgcaagtgtagggtgttgcaaaagaaagtaatattatattaatattggtatttaatcttttattatgtacttgcatgtgtaggatgttgcaaaaaacacagcaaagagacagttgtaaaccat

SEQ ID NO: 6309 - DNA, 1000 bp, Glycine max
  Soy_ogl_3092 Gm09:31737901..31738900 Cluster 27
tcccgttcaacttttgatcatatttaccttggttcttaaattcaaaaaacgtgcacaattgccaattcttttgaaacatgcttatggaaatcatcatatgcagatcatgtggctatcttctgtataaatgtttcttgacggaagaagtttaatgtacgcacctcaactcaatctcaagtaccttgtctttttatattgaaattaaaaaatatgagacaattacagataatgtttcgcaaaaggactaaaacatactttaaaaattttcaggatcgagttcaatattttcaaaatttaagttggagggtaagttggattcccatgtaacaatcataatcaaagtaagatgtcatggtttgcaatgcttataaagttggttgcataaatctttgttgttttaaatacttgaatatatagttacatttgctaaacatgtattaaagtaaaggttatgaaaggcttcgatgtcagagtccatggtcttaccttgtcttaagtttattgttcctgtgaaggatagtctctgaaaaacagggctatgcagataaatatattcaagaatctggtcgtgcttcaaagttttataaaataaatcagtcatgctttctgagtacttgttgaacaaataatcagttctctgatttagaagttaataaataagttgatctatattatcttgctttagcaagcggctttactactctatccatcaacaacatgcattacattatgcgcagtttctttccttgtaatcttattatttgggccattttatatataacgagaaacctcatggtctttgttagaagaatgcttataactcacttttacaaaaaaatttgtatgaataaaacaatgaacactacccctaatataaaatttagagaaactgacaacctctttcagatagtactattaaaagtgatagattatttctttttataagacgcattgaaaaagatagaataagaccctagaatttgtgttatgacccgtgatg

SEQ ID NO: 6310 - DNA, 1059 bp, Glycine max
  Soy_ogl_3106 Gm09:34564742..34565800 Cluster 27
tatgttttcatgattaaaaattggctgggtagaacgacttgtttcctcatattgtactaaataaaagggttataatgttaatgttccaaatattttttttaatgaaatcagtcaactaatagagaaaagtaaaaaaaaaaaaaaaaattgtttttttttatcacgattagttattaggcattttttattacagtaaaaatttaaaaaaatcattattgtactaaatcataaattacattcctggatcaatcctaaattctaaaaaaccatcccatcttaaataattaagtgatcgggtcttcaatgcaagagagtaataaaattcttgtcatatacagaatatatctacttacgtacacgtacgcagttaaagttccgaatgaaagatatagagaggatttttctagcgaagtgttaacaatttacgtgatatattaattttcggtttacattagattattttatatttaaaaataataataaaacctgtttatgaaattaaaaataaaactcatgaaaatatatttcaatataaacaagaatgtacgtgagataacctgaataagcacgagcggacattcaatgattccatcagaaccaggaacattgtaaagtatttcatcgaagaaaggaaatgggggcataaaattgtcaccaaattgttcaattgccacatctgcatctgcctcaatgaacaagacaccttcctcatcacaatccaccgttagttttccattaggaccctccctaagccttccagcaaaacgataataaaacacaagtgttttggctaatgcttttctaatgacttgaacagggtctttacctgccattgcaggttggtaacgatagaattgaacaaatggaagttggtaacgcaggccatgttggtcatctatgcctgatagcagcttaagctcacgtggagtgggatttgctggggctactagttctggtgggtttctccttacagtaaaatctagagatgaagtttggagaaccaatttatgttgtataggaagcaaagaagagaggtggatgtgctattggttgaagttt

SEQ ID NO: 6311 - DNA, 1000 bp, Glycine max
  Soy_ogl_4060 Gm12:22695101..22696100 Cluster 27
taagcatactcatcgtcaatgtgcgttctcggaactgaattcgttcacaaaccacaattgaaacacacaattaggtgaaacaagcaaaaaaaaaactaatataaccgagaaaagggattgagaactgaattatttactagtataatatatcatacaaataataaaagaatattgaacgtgctggtgctgcgaacctaacaatctttagagaagatacaaaaaactatttacattttaaaaatctgtgtattgtgatataattccatatatatatatgttctcttgtttgccttaaaaaaactaatgctatttctattccccattgttgctactacacttccttttgatttttttttcaaaaatacccaatgaaatacattttccttatttctctccataagtttatctgatgaaagaaaaatgcactttcccaataaatcaatgaaaagagagaaaaacaactaaaaagtactataatttttcgaataaaatgtgtgaatcatgcttatactaagtgaagagaacaatataatcatccaccccttccattggtttaaggagcttatttttctacaaactacataatgaataaataaacattaaaaggcctatatgtcgatcaattaaacaggcccgagccagttcttataaccaaattgattgacatataggcttgaaacgtgaatggagtgaatgagagcggggtggtatggcactgaatggaggcatatttagtcaagtaaaattagatgagacttactaatagctctcacgtgatgggtgaggaagtgttttactcaaaagtttttcatttctatgctgcaaaagttgtttggatgtttatggaagagtacgtgaattgaagaggtctttaagttaggaatttttcactttaaattggttgagagaaatgaagatcacttattgaagtcacggtggtagtagaatgcatgcatgaaaaatagttgactatcttttggtctttggtatattaagttag

SEQ ID NO: 6312 - DNA, 1100 bp, Glycine max
  Soy_ogl_5072 Gm15:17784401..17785500 Cluster 27
acaaaattagatccagtatatcatgattggttgtaattgatttaatcactagaatagaatatcttcaagtatttgattaattttccccatgtaggcctttcctattcttagtgcccctagaataatttaaatttttaaagtgttctatgattgccatctcgactcgtgcaacgttctctcacttttagccatatataaatgtttcgtctttttaatttagggggccatggcccccctcacctacaactaattgccactgggtagaatatatatatgccaaagaatcctatataatttaatagagagaccgaaacaaaatcacccatttataaaaacattgaaacaaaatcatatctcctatgttaacttcaaaatatcttgattggtagtgattgatttaatcactagaatagaccatcttcaagtatttgattaattttcccatgtaagccttacctattttgggtgcccctagaatagattaaagtgttccatgattgccttcatgactcgttcaacgttctctcccttttggtcatttattttaattaataattaatgtttatttcattggccctcctgtgcttaattagtaggttttgccaccacttgtttttcttctctgaaaatagtttttattcacttacaaatatccttctttgaattcaatcatgcaggttcaagacactatctatcgaatattaattaaataaagacacatctagaagactagcctcgatcttatattatgatctttattctttttttttataagcaatattttattgataatataaatactcaaattaagcagaacaattgcccaactcaccaagactcaataaattgatataccaagaaatatttaaagagctaggtaaatgactttgttaagagacaaatatccaaattaaaagaaagacaccaaccaatcaaaatgacataaaactacctcgctgcaattagtggtctcctaaaatacccaaaatgagaaaactatgaaaattaaggacatggtccactgcccaaaataagtgacagtgcaacttcaaataaaaacgaaaatgatataaaatcttgtaccgaaattcaagtaacgc

SEQ ID NO: 6313 - DNA, 1000 bp, Glycine max
  Soy_ogl_5112 Gm15:42950001..42951000 Cluster 27
aaagttaaacaactaataagctggattttttaaaggataaaggactaaaagtatatcttaaaaataagataaagaattaaaatataatttaacttttttcttctttagcaatgataaatctacaactgcagtagatttataaagctatttcacatggatttcgcataagttcaaagtaaatttaattgaaaaatgatccaatgataaataatttcatgcaatcggttattgatgatatttgtaaaaaaaaaaaaaaaagcatgtttttatgtaattatttgagtcgtgaaggtagggaaatgagcaggagaaggttcatgacctgcaagaaagaagaattgaagcttcccaactacaaagatattgaaatacaaattagcaaggcgagagggaagcatggatacatcatactgggaataacaagaggataaagtcgcaaaaggagcacaattggatcactcacactcagtgtgagtgtgcatcacactaggtgcgaaagataaacacccacgctcaacgtgagcagttcaaactcgtgtggaggggcagtaatgtaagaatatttatacgaagaataacacatactttatatgaattaagaatatttaattcctttgcttaattacacactccagatactagggttttcaatgaggcaaactctagtgagcaatgaacaatgtgacaacaaatgaaactaatcttgttatttattaatcctagataccttttattatgggctcagtggtttgacccacaccatttttcacactaattataattaggtttccgaagccaggcaagaattaattgcattattagttggttcaagtttcatcaaatagatcataatattagtgtattttttgtaaaataaaatattataattaattgtagcccacaagaatttatgggaaaattctaataagtaatgcattcatgttgagcgtgaatatgccacactcgttgtgaacgaacagtctaaaacaacttcataagc

SEQ ID NO: 6314 - DNA, 1000 bp, Glycine max
  Soy_ogl_145 Gm01:43029801..43030800 Cluster 27
gttgttatagtcaaatactgctaatttaatttgaaatgatatgtaataattgacattagactggtgccatcttatataccctttaaaattgttcgtttgctttatttatagtgccttttcatgttttcaacagcaattttgggtcacttaattaacatggtggattaggtattgtcaatgttaacgcgatggtgcaaaatctagtaaccaatcctcaaaagctgtcattcatatatttttattcaaggctcatgttttaaaggttcgtcactatgacgtttctaaaatcttctagaataaggcattttttattaggttcaacaggttgggaattattttaaccttgctttcaagtttgacacacaagtatatatactttccagtttccactactaatcattcaatgcaattatgttcttctactgtatttttctttaaaactgtcgatgttgacatctctatacctcttcaattccgaaacttctagctttacctttcaatttatatcaacgtgtagggtggcatttgaacttggttacacacaattcatctcaccacgaatcgcatagtttatttgtcgtgaaattattccgatttaattaatgattctttggtataattatgttaaataatttttaaaaaaaatattagtcataataattatattcaacttaaacagaattaactctgtgggagattatctggattaaaaatgaaattttcttatttgcttttggtaacagttgtgagcaagaaatatgcttgtcacatatatttcttttttttttttctcgatgcattcatcattcgctctgtacatattgatcggacacaaatagcggaagaacattatatataacacattgcgtgtgactcattgttttgtttttctctgaaccaatgaagctctctgaatttttcttcttttaagaaaaaaaaaatagtgagtgaagggaactgtgggaatactgtttctagcaccaccaccactattatgaag

SEQ ID NO: 6315 - DNA, 1004 bp, Glycine max
  Soy_ogl_4070 Gm12:33535922..33536925 Cluster 27
tggtttgataaaagagaaatggagtggaatcgagaagaattatttaaattaaagtggtttgttaagtaagaaaaagagtattattactaaaaataatattatgtccttatactttatatttactaattttatgatttgcttttcttttcatcaacaaaggaagtttgaaccattaaagaaagtgtgttgattttttcatcaatagcattctcccttggcttatctaatgaattctggggtgggcatttgtcctttttcttgtttactatcataaataaataaataacttatatctcgaatcaccttccaattttttttcttttctgaatatttatgggattcattcattgtgcagctgttttttctaaccaccgtgctgtgactgagacaaaataaatgttgaccagcaaacccagtgcagtgaagaacagataaagaaagagagagggggcgatggagcgaacaagaaaggggtacttcagtaaaatgtcacaatttcattgctcatcctcgcatagcagagaggaagttcaaagatgtgggtctcatgatttttttaaaaaatttcatgctcttctgcgcatccaaatcacacattttccgaaatcattatgcttcttcgccccctcttccctcttctgtggtaccaaactggcccataaggattccaacaaccaattagtcaatatgaatatgagagttagtgatattttaggattatacaacctacaacatatgattctgtgtgcttttacaggtctccttttgatcatatgagagatagaacgattatcttcttcttagagatgaggtatttatcttctagcaagtaggtatacaggaggtttgagttgaaattgaaagttattattgatgttcttagagatcatcttgggcattcgtattactcccttactctaactatggtgactggatttgggttgagttaggactagttcattcaactctatagctcatgatactgaggcagtgacccacagatg

SEQ ID NO: 6316 - DNA, 1600 bp, Glycine max
  Soy_ogl_43 Gm14:28978401..28980000 Cluster 27
aggaaaaaccaacatttaaagcaggaataattgttcaacaagcggttaagtttgccccaataaatgaattactgacataccgaccctttaagatccttctaggtcgacattagctttagaagctctagcagtcctatcgtcagagttagcctctagggtattaataaatccatcatcaatctcttaatcaggagtctccacatcaatagtttcatgtcccaaaaaatctttattcacggttctaggggctctaggatgagtcggacgaagctaatcgtcaacccaaacacaaaattgtccattaacaacttcacaatgaggattatagagagatttttttaataccaactttgggatacaagaagtcgatttgcttcagggcattttttaacgagtctttgatagcctttttgaaattctcttgccattgatccctggccacttaccgttagcaagattttctatcagctaattcatgtcttcattaagtcggacgatttcctcttctcctcgctatgcagaagtttctaagtccttagcttggagcatatacttgttaagctcttctgtcaatgcatcatcatgaccacagaccttcttttaaggcggcatcctttcccttaatcagctttagcaggttaacattacctagggattgctttagaactagaatgcttttgtactcgagagtaatgtgagtcagatactctttatacccctgtcaaaatcaagatagcagaatccaaattggcatgaacattcttctgaacagtatcctagttcttcgataaaatagcacaatcaatctccttgcccgaaaacatccacttagtaggaccgccaaacttcttagtaagaattaagctagagcctgttaactctaaatcatcatcaatattgacgaccttttttccttttcgaagaaggaggatgaggtatatcatgagaagctttagagtgaatctccatagcaagacctttccctctgtcagacgcttttgacttattcaaaagtttcttcttatcacccctattttcagtataaagaggagcgattgacataggcttattctttgatttccccatgagcacttctgcaacaacagaatgcttgctaatgtcaagcacattcaaattccaaataaaaacaaagcacaaagaaccaacacatacctaaaactgacttccaatcttcatcaacggtttgtaaaagcaatttacaagtgattgcatctcctttctcattaaccaattcgacaatggaattcgtagaagcgagcttttttgtagacaactcttcctcttgtttcccattaaaattaaccaacttattataatgagtggaggaccaataaagctcaaagttagacttaaattgatcaccaccctcacctttattaacaacaaagaggtcgtcccaacaatctttagaaggtctcagctagaaatacatttccttaaaaattttgcatgattcttcataagccttaaggattgtcatatctttacgacctttcaaagaaaggcatgaataaccgaaggatttcttgctatgccagggagtgaaaaaataatgaaatacattaagggataagaggaa

SEQ ID NO: 6317 - DNA, 1051 bp, Glycine max
  Soy_ogl_5732 Gm17:36446301..36447351 Cluster 27
tatgagcatattccttataccaacattcagatgaaattcaaaggatgatcaactccttttggtggggtagtaacaacggtaatggaagaggaattaaatggcagaagtgggataggttggcagttagaaaagagttcggaggaattggttttcgtcatttttatggcttgaatttggccatgttggaggagcaggggtgaaaacttgtttttaatccagatgttatggtgtctagagtcttcaaagccaaatactaccctaggggggttttgttgaggccaatctaggtcataatccaagttttgtatggcgtaacatccacgcttcacatcacaggtgatggttaaagaaagcataatgtagcgtgtaaaatgtttaacttgtggcatgatccatggcttaggtatcagaaaatcactttgtcacaagcagtctcatttctgtgttgcaaatctcattgaagaccggtcaggaggctggaacttgaagttaagcgacaagctaatttctctactcagcttagcaagagcgtcgcaatttaatgctagtcaccaagattatgattacataccatcttttattgagcatgtcattgttaatgaattgagttgagatgttcctctgaaaaaaaaaaaaaactaatccattttgctgattctctcttatacagtctcgttttaatgttgatgcttgtataatcctagtgtcccaaacatttgcatataagtttttcctacgtacctaatttgaaactatcatgcctgcaaatttcatttatctgtcgcaataatttgggatatttaatttatatgaagttatcgtactatgaaacattaaaacatatgcaacttagtcatttggtccttaaatagaacggtagatgtaatgaaattcggttcacgtacttcactggtaactaaccgaaatgactagaagtatgatcattaatgagtcacatcaaataaattacacattgaatgtgatgtaagtaaaaggaaatttaaattgttttatttattcgtatggtgtaagtaaaaatgaatgtgagtaa

SEQ ID NO: 6318 - DNA, 1200 bp, Glycine max
  Soy_ogl_6719 Gm20:31398601..31399800 Cluster 27
gacataaatgggcttccacattccatcttccactttctcattaatagctaagaataacttctccatgcaaatgtcaaagaggcaggggagagaggtttctcttgtcttagtccctttgtgcgttggaaataggggagcttatttccattccagagcaaagataaagtgaaggaggtaacacaacacataataaaagaaaccatgttttgggggaagccaaaatccaaaagagaagaatttaggaagctccactcaatatgatcataggccttttccagatcaatcttgtagaccatatcaccttttctcttctaagttgcacatgttatgaatgaattcttggagaataatgacattattcgaggtgcttcttcctggaagaaaactactctgcaggggggcaataatgtcttctatataaggtctgaattatcttgtaaatgattttataaaggctaataggcctgaattctctcaaattgacttggttatccactttgggaatgaaagcaattaaagtttcagagatggtcggatcaaaacaaccaattttgaaagcttgcttgactagcttccaaacatcatcccctaccacatgccaatattgtttaacaaatgttctttgatacccatctggccccagagtcttgtaaggtttcatggaattgacggcctgggagacttcatctttggtcacagttctggacatatgttacttagcttcctcccccaactgaggtatgtgagcaacatgaaactcctcctgagcaacactacttcctgcagagaaaagcctcttgaaaaagccaaaagccttattttgaaggatagttgaattagttgaccaagtgcaattagaaagacccaacccatggactttattacgccttctccacatgatagtttgagcatggaagaaagccgagttcttgtgcccaagcttaacccattgctctatggacttttgacaccaaagaagctcttcttggaaaagaatttggttgttgtcatgttggagggttttttccaagttaactaaagccaaagaatccacaatttcaagttttctttaaattccttggagtctagactctgttgcttctttcttctgaaaatatttccaaacacctctttgttaaatttaatagagtcctctttaactttttgcaaagcttcaagaagtttaccaacatggtactt

SEQ ID NO: 6319 - DNA, 1200 bp, Glycine max
  Soy_ogl_5357 Gm16:26911501..26912700 Cluster 27
tcaaaatattaattagaaagaaaaacatatttaacgctattagtaatatactttttataatacgtgaaacttcgcacactacctgcaaacacaaaacatgatacacatttggttatctaccacaatttaaattacatgattttacattaaattaaaattacaaaaaatcataaaatcatatgaggtgataatgacagcatttagaagggaggatcgtacgagggagatagaacaagagacgtgtaactgtgtaaggttagtgattctgatcatggagaaaagagaaaggtgtgtaggggtatgaataaagtagatgagtggggataaaccgaggaaggcgttaaagttcaacacacaagggtatgtaagggtggaggtggcattagaaggtgaggggggctaatagtaaggcccatttcctgcgctaatatacccatgatggacgctgaagtcggtggcactaccctgcaacgtgaagcatcttttctgggaacatgcttcgatgatgggcaaggagggttctcgagcatggctctcggtgtgggttgccttgctccgtgttatttggcaaaagcgcaatgagattctctttaggaatgaggtgctatcctttgttgatttgcggaacgcattcgtctacaaagcttggacttggttgagggcaaatataaaaccattcacttattcctagcctgaatggtattatgtccagcttcatgtatttctaacttggatgattagattcatagcttgaattcatggttgttggctcctatcgagtttgaattttcacggtggttactctatgcttttgatactgtgggtatctcatggtttgaagtcttaatatgtttgttctagggttgatattttatagtggtttgtgttctctgttatgtgttatgggtggcaacatctcttatgcactaccagttctttcttttgttttaaactatgtatctccttgttattattatttatatatttggcttataaaaaaaaaaaaacgtgttcatcttctaattggtcgtgtgcttaatttgtggtcatgtaccttattctctaatcattggttttaaatgaagaaaattttgaggaaaaaggaagataaaagttgtaaaatgtcaaaagctcaaaatgcgagaaaactattatatttttttatttcgaaaattgtggagggaaacttcacaatctcaa

SEQ ID NO: 6320 - DNA, 1000 bp, Glycine max
  Soy_ogl_6384 Gm19:31511001..31512000 Cluster 27
atggttagtggtgaggaggaaaaatcataagaatcaagttgagaagaaacaaaaagattttgtttttaaaggtttgcagggatttttttttaatttatttaagaatcaaatacagtcagccaatcaagaggcttatctctccaatcatgggcatgtgattgctaaccttgatgcaaataatgaaaagaaaattttgcctgaggttatttccaaaagtaagcatccgagaaaagacattgatacccctattgttcagatgttgaaaaatgcttccttggccaagcaaaaggtttggaagaagtgtcatgtgggtatggcagtggcgattgtgggaccttccacttcaaaaagtccaaatgtgaataatgtagatcatgaagggaccttagcgatggatatccaacagccatccttgggcaatgttgaggagttaaacacgcagaaggagttcattgataatgctatgtaagtggtaatggagtcttagggagtagaaggggttgttaatattgcaattccactagacaaattctcttcctaaaaatttgttcctttcccccttaagccttgtccgttagttgcttcaataatttctccttcatttcatgggatattataggtgctagtggcaagtgcacccttcgtcacttaagggagatggtcaataatccatgttacctttttctatataaaactcatgcaattctccaaggttgcttctttttggaatagtctaggttatcattctttctttctacaagaggccacattggtggaatttgggttctgagtaaccagagtgatgccacttgtaatctagtggacagtatggaataagctattacgttctctttgtctaaacgtaatgctctttggttttgttcaactatctatgcgtcgcccaacccttcaattaggccagcttatggagttacttatgtaacttgagtaacaacattagtggtccatggttaatgattggagatatgaatgatgttct

SEQ ID NO: 6321 - DNA, 1093 bp, Glycine max
  Soy_ogl_5475 Gm17:3403108..3404200 Cluster 28
ctcttaaaaaatacttgatagagactaatatcaaattaataaatttatttggaacccaaataaccttttttctcattaattgatatcctactttttactataaattaagaaagtatatataagaggttggtttggttatgcaaattttacaaattgacaaagggcaaatgactccaagcaggtagtgtgttaatcaaatacttgtcttatcagttaggtgctaattaggcaaaccaaaccacctcttggataatttgcatgggtgtgctaatcgatgggatgattacctatattttttaagaggcctaaccttagattaaatgttgctttcgcaaaacgaactactgctagtttggttaatgaaacgaaaaaagacacacaaaagggagcttagttttacatttactgtttatttatttatttattggaatcgattcactctccaccagaccatgtatcatcattgtatatatcctaaattcctaatatctattacacttttacctcataaaatgttagatcaacactttattcatggttagtccaattagtaaaatcttaactaattcaactaataaattattaacaatagttggtaatagttacctttaaggaaacaatctcttttttttagggggaggaaacaatctattaacacttggtaaatgcaatagagaaatataaaaaagaaaggtttaaattgtagtaacccatttctcaaaaagacacgatgggattttattgctgtgcctctctgggttgtacaaagcctaataaattcgttgaggtaaataattaataaaaaaaattcagtttaataattgaaaacatctgccaatttgtatcatcatcccaaaccctaaatgcaagctgtgtaaaactgtaaaaaagaaaaaagaaaaaaaggtgaaggagcagaaaattttttacggcgtgaaatgaaaattcactgtggtgccacgttgacaaggaatatccagacggataagctcatatgacgtgcagaaaatatatgatactgcacgtacgtagcaaaagtcatttattaaagtgactccttcgataaagtggagctgacagataacctggccaa

SEQ ID NO: 6322 - DNA, 1091 bp, Glycine max
  Soy_ogl_1995 Gm06:16905510..16906600 Cluster 28
tgggaggggggtggttgattatcatctaatgcttcgctcatgttgtgaaccttttttctctctactatcgtactagcttttgtattttgtacttcactatctgggaggtgttgtttcagattttgtctaaggctgattcaaattttataaatataataaagaaaacaagaagaataataagaaacatgcaaaacacataaaaagaaggaaatgtaaagagacagcacataaacccaaaaccaacaggaaaattgcattacgatgcctgttgttgtgttcaggacgtagattacttaaaagaaagggagagacatggacaagggtagttgtttttttctttcttttggaaacatagattagagtagagactatgaagtcttattttggataaactttttgctagtatttataagagagaaaaaaaaaagataaaatcacttgagtttctttcataagttaaagttaacttatatacttaactaccataaaataattatgtacttaatttttattaaaaaaatcatttaacttctttaaaagtttggagtatttttaagttggttttaacttaagagaaaaattcaatttatttgatcttattttcttttattataagtgtcatgcagaattttatccggataggatcggagcatttttaagatttgggtcaatttgttacaaattaaaaaaaatgatttcaatcttataataatttagtgattatttaaaaagctgattcatgtttatttataaaaaaaaaacaactgattttgagaagttattgttttaatcagatttttttatttctgattattttgaaaaattaaacaaacacatgaaaaaatttaaaataatgattatattttagaaataagtgattctcctctttattatatataaaaaggttgttttcttgtttgtccattgaaattcggtttactgtatctttggatgagattcctctttttgaacttcggtcgcaacagtaataatgccatggcccaaagcccgttttactgaaggaaaacgttttttgtggcattctacggtttggagctttcgagttagagaaccagttttaatgtttacct

SEQ ID NO: 6323 - DNA, 1452 bp, Glycine max
  Soy_ogl_2567 Gm08:8845449..8846900 Cluster 28
gtcctacatttatacatttttttcaaaattacactaacattaatgagatatacttcttttaggacaataattagaagtcgaaaaaaatccaaatctaaacctgaaatcagtcaaagcaagttttcttcccattaaagttaagatgaagttaaatggtaaagtttgtgaaatgataaatatgtaattaagtcaattatttcctcataatattcaccaaattaatacattagaatgtgttataaaaaagctctataaatctagatatgttttagatttatcaacgatcttgttgagaatgccaaattgacaatggatatggatatgcatgattttggacagtgagactctctatcataactacttctatacacttaggcttccgttcccggcagcgagtatgttttctataacacttcgtggttatataatgttttcattttcatctcatacttccctttttttgttcttctaaaattatgttggtgtcttttttttttttatgggacatagttggatatatgaacaatctaatttcgggtaccgtgagtaaagtaacttttcttccatttagcaactctacacattcggaaaattttctgaagagcgaatgtgaaagcaatttgcagctatattgagttgctttttttaattgttattttttttttatcaaatacacacattgagtgtgtgtttgtaggcatacttaatcacattcatcttttgttttttgacgattcataggattgggtcccgtttctgtaatagggcgggtagctatgtttatgcttggctattatttctccttatcaatcagcaggtttgtaattgtaactacattataaaacaaaaagccgacaaagattagataaagacagaaacggacgtcaaaattgtcaaaagattttaagagcttattgtatagtacatgtttagggaattcagaacaagttattttttgactggtcacaacaagttaccttactttaagttaacataattgaacttttgcaacagctcccttgaaatacaactcgactttctttattaatggtgtaagtaaccatatacagttttttattactgtgctaaaattctgattttgttttggaaggaggtttagaattgagattattagcaactcagaactttccatcttatctaactaaattggactataaaataagctaacagataatcgacccaatggagattattggtcaaagaaaagatgaactgaagccgccatctgatttttcctaggataaaattatagataattgacacaacgaagattatttagtcaaagtaaaaatgaacagaagcagccatctatctagtttttttaaggataaaattataatttattctcccacgtggaaagcatttgtaattttcctgaaacagaaggagtcataagtctttaaacaatataactaaaataagatttggctg

SEQ ID NO: 6324 - DNA, 1200 bp, Glycine max
  Soy_ogl_2988 Gm09:4394901..4396100 Cluster 28
ttcaataaagtttgacgcagacataatagaacaaagcattctgttctagtccgttgcctttgattcccaccttttcaagagaaccaaaattgtaccacttttagtattgtgttgtgttatgttctagtttaaaaatacatcaaactgataaaaaaaagatagaaaagagcccatatattatgtttgatattgttctaatacggctaccaatagctaccttcaagtgatgtctaggatcttaggatgtttcatctgcatatatttgatttgtagatttgcaaaattaggataaaggcaactgactaacaatggattctaaactccacaaacatatttctcattccatgtgcaagtcacctggctgtgcagatggagaggagggtgaagtaatagatatcctttgtccttaagcccaaaatttaccaagaaggataatgattttacatttatcttatttgccccaagacaaacatgtaattattcaccctgcataaactataagataaattagattggtatttgaagtgtatctagatgaaggatctagtggaaataataatcaatgcaaacctcacacttcaaaaacattgcatttatctttttgtttgacaacttttgtaggatcatgaaacaaatgagctgcatgatgttctatacaattataaatgctaaaattacagaagtccaatattaaatttgtaaaagaaagatgcccaagtggtgtctttgacaacaagcatcagacattattagacattgatgtagcatggagtatactacaatatttacatataaaaaaaaacagttgcaatacaacagaaaaagaaattatattagcacacgtaatgtagtcatttcatgtaaagagcacatcatcatgattcccttgattcttgaagataaggaaatagatcagccaaccaaagtaacaaagcatatcaatttaatttgttgaatattagagcatgtgcccgccctggcctcattgttgtgcggttgaagaaaccctcaacagtcgaagtaaattaaaaagcattgattctgaaattcagcaccaaatacggacaataaatgtttccaagggttatgcccatcgcaggcataacatggaacgtactacatctacatgggatgacaactatatgctacatgccggcctacatctacatttctctaatattctaggaatatatccttcat

SEQ ID NO: 6325 - DNA, 1200 bp, Glycine max
  Soy_ogl_5653 Gm17:12647601..12648800 Cluster 28
aaaaaacataatgaaaaaaatgacattagactttttttttacactttttcctttcatcttcttcctacaccgtttaagatcttgaaaacacattattttcctttttcttcttcgggaaattaaagtcaacacaacttatatatatgaagttattttaattggattgtattataaaatttaacataattaacatgaaggtagttatattgtcataaaagatgcctaaatttaacataattaacttgaaggtaatttattatagttactgtctagggttcgaatcatacttaaatatgaaatatatcatattaaaagaaaaatatttattttgtatacgctaaagatcctctacaaatattacttttggttgaaacaatttggtaccaagatcaagattaaaaaagtatatcatcatatgacgctaaatgaagtttccttgttgtaattcgttgtctattttgttacttcaagatagatgtataattcaatactaaataagttggtcaaatttatgaaaaggactcagctcaaacatctgcagcctattttaaatcagattaaatagacaatttcaaattgattttatcaataaatcacaaaacaattggaaaaattaagtaaaggtgttttatagataaaaatgcggggtgccaagattaaaaaaaactcttaggttacccttcctttgataaaaaaaaaaacaaaaaactagataaataaaagccgtcaacgttcaaataaagataatagaaaagaaacaaaatgaaaagcgattttttccgcaagctaaactatcaaactacaaggattccattattactttgttcctcttccatattttgttgatttgagaacaagctagtaaggacattgacattgaaagttgtagtaggctttgtgtgctattacgggataaggagacatggaatatagataaaacggataaggacaacggtttgggtaataatataaggccatgagtaggattggcaaacatggataagaacaaagtaagaccactcaacccaaccatgctgcacactcatacacatgtggacccaggcttcaacacttttcaactcttatcacctctaatattattattatatataatttgaatctctcgtttgatttttaatcctcccgattgtgttgttctaatgtcatcttcatgattcttaagttagtatcgttaaatct

SEQ ID NO: 6326 - DNA, 1700 bp, Glycine max
  Soy_ogl_3806 Gm11:9036901..9038600 Cluster 28
atattttgtcaacaaattgtgggagctagccaatagccaaaaaatgctaaaataaagtccatgttgtaacacaattatcatgattaattaaattaacaggagtaaacaatgattaataataaaatataaattttggtatctatagaagagtcatacaacatctcatttatcacataatgtatactaacatcattaaagtgctcatatagctatgctaagggaactagatcccatgcatacctaccacaggtttcgatagttctgagaatgtcacatcggtaccattgtttcaatacgcttaagggtaaggcccggaaaatttgtcccgaattaaatgttttctggggaagctttgtcacgacaaaattctgacaaatgctaggaggttgagattgggacttactgatgaaaacttatgttgtttatgtgttagtcaagaggaatccttgttccatctgttcagggactgatgaagtgagactgatatggcaatactttattcgaatggatggagctggtgatttttacacgtgccttcaatggagaaaatggctactctcaaatatggctcgtgaacatgtagtttatgacattaagtggaaccttctttttggagttattctgaacttggtttggtggaaacgaaattgttaagttttccaaagtgagacgtggtcagcacaagatgttatccaaaaagctggcagacttgctcgggattacatgcagggaattagcttgatgaaacctctcaatgatacgagaattctgagtgatgctaacaaacagataagttggaaatgtccgaggtttgtgatggtgctgtcatggaaggtggaagcaaaggggcttgtggcagtttggtgcgtgaccacacaggagcttttctctgtggagtaagcattaacattggtaaaggttcagttttggaagaggaattgaagggtatcctctttggcctgaagctagcttggtcgagagggtatagaaggatccgggtggattcagattcactggtcgcgataaagctcatgtctaaaggttgctgcatgcgtcacccattttataatctggtccaggagattcatgcagtgcatggctatcaggggaacatttattggaatcatgttctacgtgaagctaaccaggtggcagatgctttggctaagaaagctattacgactttaagtctttatcaagtttttgattttcctccttcatgtattgtttatgcactttgagctgatatagctcatatttcttcccaagaggcttttagccctcttgatagtttattcacaaaaaaataaagcttaagtgtaaaatgaaaaaaaaaaaaactaagggtgtatgattagaaaaaagtgtgcaaaatactatgggccaaatgcttttggtcaacagtaatgggcccaacgcccacgggagcaagcccaagcacaaaactgaagcagacaaagcctagttagacagccatacgatgttaacaaaggatcgactactagcacaagtgcaaatagaacaaacaaaccgtaattactgattttcatttacaaaaaaagggttggcagaagtgagaaacatcttgataggagtgtcaaagtaagcttaaacccaatgagtcaacccggctcatcatgcatctaagctaaactgggtgcaaaaaaataaaagttttacggtactaagagaaaacaaat

SEQ ID NO: 6327 - DNA, 1088 bp, Glycine max
  Soy_ogl_2186 Gm07:4500601..4501688 Cluster 28
acctctcccatcttaacatgcaaacctctcccatttcaaatataatttcataatcctttttcttttttaagtgaaaagttatattaaaacagaagacactccagtgttattgtaatccttaagaggcttttcggcaagtttaatttttcttacaaacacttgttatttctttgtattaatattatgtttcaaaatacgttatacaacaacacactggtcgatgttattaattaacgaatgaattaaagtccaattgaacgacaatatttaatgattcgagtttcgtgaagatgatgagtgcaaaacgggaaacaagggcagaagaaacaaaaaaaaccttagaattaaagtatctgacctgagtggcacataatagcatggaaaattactgatatcaacagtgatgtgtgaaaatggaactgaaattgttttcaccgtatgggtaaataaaaggaaaaggaatcaatcaacggacagggattggtgaaggacaaggcgagcaaggaggaccatcgatacagaagcagacaaaggaaagtgtgggtcctgaacacgtcaccctgtgagcgttgcagcgtatcttccgccccatgtgttgtggtcggaatgagaaaagacagttctatccttgagtttgagtggagtgtgagagaagggatatggaggagcaaatgggaaaattaaattaagaaagaagctttgaatggcgtggaggggaaaaggagttgtcacagtcagagaaaaaggggttactagttagtgcagtgcagagcgcatgagtgagctagggagcaaagcgtggcaggctcgtacatgtaaacattgcccttgatgtactcatgtactctttgctacagagttctacagtgtgcaaaacgagcaatcatagatacatcatcttcctttttcttttactttttaataataatactagtatttttcaaaaactgttactagtattatcttttaactaatagtagtacggtaaataaatgaggttttttagtattccaaagttactttacgtttcaattaatttaaaattatgttagttgaatagctttgaacttaaattctctagatacttt

SEQ ID NO: 6328 - DNA, 1400 bp, Glycine max
  Soy_ogl_6244 Gm18:58136901..58138300 Cluster 28
cacgacaaagcatagcaaggcagaaggctgaagtgttaggcaacaacatgcatgaatattccaccaataaggtgaacctttttgtagtaaagcaaacgataaaaaagagagtgagagaggtgaaaggcagaaaattcaaaactagtgaaagaacctttcttacttatccccatctttcctactcacaaaatcttgttgcacccctacctttcacttcaagacatatgacatgcacaccttttttttttccccttttgtatatttaatgctttaaaacttatttaaaataataaaaaaaaagctatcattgtttttggccttctaccgttaatgttaactgtgcaaattaaagggactttctttcttcttggactccaatgggaataagcaagcatggaaccccacagctttagtcgcttggaagagtatccaattcttcacaaattttagtacaagtgacagtgacttgaaattctttaactaaaattttagattttaatcttgtgagtgaaaagaattccataattagaaaaaaagactttaataattagtaaattttttgacagattaaatatttgggaccaacagtcataattacataaaaagagaaaaaaatataaagaaagaggaaggaaatttgccttaatttcatttcatccttaattaataattacagctactttcttcctccattatagtcattgactcattcaataaaaagctcccttgaccaattccacccccatcttattgcattgcctagaggccctcccacacacagcatacagcttgtttgaaggtcatcatcatttgcatttgcaggctaacttcattctctactacatagagcttgggcactgctttaagatctaatttggctattttttttttctttttgtatttgagtaattagtgtgagattttttaatttttgatggatttgatgtattggttgaggattgaggaattttcaagtgatcaccttttgtgttatccgtttgaattatgatttcttaaaatattttttaatgtttcaaaatctaatacatatttcctaaaaaagaaatagatggatatccatatacccatgtgggtgtggattgagtaaagaacggatttcatgcgtgagagcaagtaggaggaggggtgctagtactagctctgcttaattactatacctaatcagcacaaaaatgcactggccttaagtatatttatttatttttctcaattcagaaattcattctgttaatttaacaaataaattaatggagagactgaacctaaatcaaggtcaaaatgtgttctcttctctgttactgacttatacttaatttaatacaagagtttattgaatcaattcgtataatttaaaaaataattaggatgaaatgaaagtt

SEQ ID NO: 6329 - DNA, 1038 bp, Glycine max
  Soy_ogl_90 Gm01:3722263..3723300 Cluster 28
ccaacaaattttaaatgactaattgtttgagttaaaattatataattgtctaagatgaaataattatgatagaatgaagcatattggtatagggttcattagtttctcaaatggttctaatttccttcaatcaaaacattaccaatctgaaactgatatggcaccccacttgttggtgtttatggctacatagaaattctattatttttcagaacaaggctcctgattttgatgctgtggtggagcatgtcaagcaaatatcttggtcctggtttccatgcaggggtcctatttcaagtggtctagctttcgttaattgctcccttaacccgcaagcaaacatcttctgtgaaaaccatatttaagcaagacttgttacatgaatggtcattctaacatgtcataggccttggatatatccaattttatgatcacctggtcactgccatgggcattctttttcttcaatgcatggcagatttccttgacaaaccgaggagagagtaaatgctgttgtggatgaggtgttacttaatttatttatgtttttggtgatgcagtagaatgggaatagggttaaagctagtgcataaaatatataaaattgcagcaaaaatgattaatgctttcagaggtcacctcccaatgattctggtagaaaaaaccattcaaaccatctggtccagaagcttgcaaagacccagagttgtccgttgcagctttgatctttgtatttgaatcaattgctaacaaattgttgttcatatatatcttgtaacactagcttaggaacactctaacctctatacactgttgaactgcataagttccttctgagtatcttctttccatatatagttttggaaaatcagaacaccattgtcataggtggcacctcagagaatacctggctaaggtaacttaaactttgttctgcagattccacttaattttcaaatggagatgcaaagatctagcttccctaggcctaaggcacataggccacaaaggttgaaattcaacttaagtcaactagaa

SEQ ID NO: 6330 - DNA, 1100 bp, Glycine max
  Soy_ogl_1682 Gm05:35147101..35148200 Cluster 28
aatagatctgatttttttgtccagcaatagttttattccctaatcttttttatataaaaaaacatttaaaatatattttattggacaaaaaaagaagatatatttatgaaaaaaatatttatatagtttcaattgccttattttgattttgggggttatttttaaaactatgatatataaacaattgaatgagaaatataaataattatatataatattacatacgatatcaatcattcaaacaattaaatggtaatgcataaattgtttcaacctacatattcactttactataatgtgacaatgacttttctatatttgaagataagaggatcaaaccttgtttcaccgcatccttatacttctaacacatagtaggtgtaaccgtgcagggaacttactttttgcaaacctttttattttcctacatacacccttcctcctttttttgtattttttcttcttttttaactctcatcgcgccaataataatcaatgcattctaattactattatttttaatttaaacaaataaattagataagagatacttttaagaacattttatgttgaatgaaagtaagctaaatttatacgactaatttatttgaacagtttcaaatcaattttgaggatcactgaaaaatacttccacctcttattgttctggcttatttaaaacttgttcagttacaaatgcaagaatgtgttgtgaattgtgttgtagggacttgcattgcttacggtacaggcacacatgggtagcctgacaccacccatttgcaatgtgtatgtgaaagatgcacattgtgaaaagcttaattagtgggaagcaagaagcgtttctcttcattagcctctacttgttggcctttggcagtgctggtttgaaggcttcgttgccatcacatggtgctcctcaatttgatgaaagagaccccaaagaagcaatacaaatgtcaagcttcttcaatggtctcttgttagcagtttgcattggtggtgcagtgaccttaacgtctaatgtatatatacaagactgctatggatgggactggggctttggaatctccactggggctttggtttaacttcttgtt

SEQ ID NO: 6331 - DNA, 1147 bp, Glycine max
  Soy_ogl_1978 Gm06:16057701..16058847 Cluster 28
ttcccatcctttgtcctctggctgaagaaagtttaagagaagtgtttttttatttggtctgcttcatacgagacaaaatttaaatcaataacatctttcttctagctatgtaaatgtaatgcaagtttcatcaataacaaagtctacaaaacttaaaatatggattagctggaagctaccggtcctctaatatttttttttgtaccatttccaatcatccatccagagcctttaaaaataatgttatttgcccccacaatgcttttctatgcataactaggttggaaaacctagctactttggccttaagaaggtctcctctatggaagaatcaagatttaattttttttcatgttattgaatcttcattttttcagtctctagtggaagagtttcgcaaatactctgtagcataatttgcctcttctctcaaactagacagttaatgctagaaaggaagccttagctgagtctcttccaggtcaaacgacattttctacatctttgcactcagcaataacgaccttggacagcaaaagaattgttaacctggaatgattttgaaagacatactttattatgatataatgccaccaaacactcaatcaaaatcactaaattaagaatttgggaaaacctcacatataattcaataaagtgaaagtttacacaggtcacagttgacaaggaaatatataattgcatggtgggtgattgttaagagcatgtatgcattaaattaagagccacttcaaagtaaacttctcaataaatttaaaaataaaacgaatcaaagaagtaaatttattaaacttgtctaacaaattaaaattaatttattcacttcacctttctctatatgttctctcttctaacattttcacaagttgaggtgttcgagttgattttaaaactatgaagcaatttaattcattttatctctttagtttttatttccttctcacttcaatacttattgaaaaatttaactaaactagccaaaggttgcttaggtagtgctcaaaacgataaaggaagtggaagaaaattcacgtgacaggttctacaggagggtctctgattgaaaacaatagcaagcatttggagtatgtctcaagagtctcataacttgatcaagactaaggct

SEQ ID NO: 6332 - DNA, 1152 bp, Glycine max
  Soy_ogl_3998 Gm12:4576849..4578000 Cluster 28
aagagggttgactgatcacgttttatttcactattccacgatattcttaacaaagtaggaaactaaaatattcatgaattaataataatagagaaaagcacctgtattataccaaaaaataaatcaataaaatagcacttacaccagaacatgtcatgtggttcttaaaagtgataaacctttttgagtgttaaccctctagatcattagtaataaaacagtgcaatcataaataagataagggaatcaaacaagcaaattgatggtgattttgattgagtgatacagcatgtttaggtatattctctgtcagtaacaaaatcaaaaccaaaatctaggccattctcgccacctcctggaaaaatacaaacatctcaggaggagcatgattcctgatgagtgaatgtgatgacactttcacgactagcaaggcttaccatgtgacaatactaccaaaaggacatcacaataccattcccgaaaatttgattcctagcactattattaatttgtgcattggtagtgatggttgctacaatggttattgtgtctctttcgttggtatatgaaaaattgagataaaatacgagtgatacatgaaataaaaagatacagagaaaaaaatgaattgtgaacaagtgatgtaaaaactatgtgagaagacacctagctatatatctatcattctattgtaaggaaaaagggaagagatgaagttgtattttgtgaaagaagaaaaataactctcaaagatgggaattgctgtgaaaatgactagtgttgcttgagttctgcattctgacatctctggagtcgatatatccccttaatgttatttcatgggggactcattgttaagatgtctccacatgcatggcttaagaatatagttaaaaaactccttataaaactgggacaattgtttctcctaagttaacttctggaattgaattacgttttaatatgatagtactaaattcctgtaccttttcccaaacctactagtttcttctggccagggtcaaagttcgctaaccaaacaattttcagattccttgcctgctgattctaaacatgaaaatgataagtttaactgttttaatttttctagtgtttgtgtcacagttcattcaattgaaaactttacagacc

SEQ ID NO: 6333 - DNA, 1000 bp, Glycine max
  Soy_ogl_4498 Gm13:36954801..36955800 Cluster 28
aaaaaaaatcactttattctagagttattaattgtacttgtttagccgttttaactaatttatatgtctgtttgcccaaaacaaatatgtttaataaaaagatttatattccactacttcctaatatttttaaaatattacttaaataaccatacttatgtgtgtgagtttacgatgagttgggccttcacttcttcacttggtgccaaggacccaattattctcaacccccacccccacacaccaccactttcctcttcacaccacccactcatattttacccctccttcacacccttttccccttcaatttgaagtctttcttctttcttcccacccccactttcatcttttcctcattgagcacccctccttattctgcttcttctcttttttacatcccctttaactcatcttcttcgcagccccattctttccttcctcttctcactgtagctcaagatccttatagataccatactttgcatagttggcacctctaaatgatgtgtcatctctccaacatctacctgttcttatccagtacacaacggtgatgatgcaattagctgtgtgatggccatgcttggggtcaagttcgaccaggcacacccactggaactaggcaaagtgtatctaaccataatctttaccattgacccaactaaagttaagttaataaacaaaaccacgaacagacatttgcgtgattattttcactttatcaaagaaacacagaaagaaaattaaattgaattaaaaaaaaaaactcaccatcagggatcacccaaagtgcaagtgtcttgagtcttgactataaaacatagtacaataataaatggagaatcccatcttcaattccaaaatgcaagcacaggttattttcattgtaaaattaaatgtaatcacattaagtccaaagtagtaggaaactaacaaagaatagcatgggcccaagaactaactggcctcatacgacactccaataaagtccatgagc

SEQ ID NO: 6334 - DNA, 1400 bp, Glycine max
  Soy_ogl_5389 Gm16:31159701..31161100 Cluster 28
gaaccccatattagcccaacttgtgaacacagatgtaattgggttttaagtggcaataccttcaagcattagtgcacactcatcactccccaaaaatctaggatcattttgcaccttcaaaaacaattccttagtgagctttccaagcccttcttctaaaactctaactaaatctctaatgttagtgtttttgtcgacatcctccaagagaaccattgctggccataacaagtttccaatggcaccttttgagaaaggctctcccatccttttcctcatgtccacaaaatgtaatgcaaccattggacttgttgtgtcacaagattcctttgtgcatgccacaatcatatgcttacacatgaatgaagacactacttggtatcttgtaggttttgtttcatcacttgattcagaccaaaaaaaaagtcatgacttgttatatcgaaaatgcttaatattacgaaaagaaatttcgtacaaacagcacgaatgatgtggtaggtgtgtttcaattcctttcatgactttccattactctttttttttccaggtgtttcaattatgttcatgtttttccgttctttgcttatcctcttcgctgcaaaagcaccacactcttcagcggcactgaaccgcatgttggttcatgtgtttccgttcctcactgatacatatatactagtattatttttcttctgttacctaacacttgcaacactcttcatttgacaccgaacatgtatagactggtacaatgttcaatgcttttaataggaaccagaaacaggagagaggaatggttgattgaataaagcttcaaacaattgatttgggtgaattactgtgtgaccattttgcagtaatggtcacaacaacggtcaattgctgctacttttagtgataaagacattgagatggagttatgaattgctataaaatgaagcattgaaatcaaccattgtggtggtggtggattgatttctttgcaaactttctaagtcctacaaagagtttgtttaagtctctaattgatagccaacattcattttagagtaaaatttatggaatatgaatgaatttaactagggaatttttaattgactaaacacaaaagaataaatttcaaaatcaacctgatcattgatgtaaaatcttcagagtttgggcttttgctgagtcacaacggctgaattatgaggtattgttcaaggtatgctttgctggtacaaatacaatcttgtggcttcacacaaatttagattagattgaagcagctcctcactgtttcaatttcattttgataattagatttatattgtcacttcctaaaggtagaaactagttatactgagtataccttaatatcaaagagattgaaaagattattgccatcaaaagtc

SEQ ID NO: 6335 - DNA, 1400 bp, Glycine max
  Soy_ogl_2302 Gm07:9114401..9115800 Cluster 28
ttgctgccagtttccaacatctacttcctcaatcaagcaaagcaaagattatttatgcttttattaactatttttttattaatgtttatctaaccaataaggaacatatctgaatgtattaattgaaaaatcgactctttttagtttttacatagtcttaaaagcctttcaaatagcaaacattcacggtcggtaactcaaacaaaatattctccatctttcttttatgatcagtataaatgttcaataattaagtatagtcaaaatttgacagggataaaaggaagaataaaatttattgattcatatagcaaaatatatagggcaattctataaaatattctccacgcactctttccttgtgttatcaatatatacggtcaatacccctatcaagtagtcaaatttgattaggatacaattaatgactgatcaaatttagtgattcatacagaaaatacatttgtggtaagtcactctttcttttattatcagtagaaatgttaaatactatataataaagttgtcaaaatttgattagaatacaaggaatgatatcataaagacaattaatacaaatatacgtactagagatttacacaggatgtaaacaacataaacctcttcacagcctcactagatttatataaatacaacaggaaaaaaatttactatgtactaaataacaatagtacttgttttatcacctttgttatcacttttcatatcatcatcacattcacatacttccgaagtttttagttttgttcagcaaaagacatagttccgaagttatgggagatcctaggtacaaggtggaagtactcacagaaggtggtcctggagaatggttcggacacacaccggattattgcagtacctatcgtggcacggtaactattttcttgattgacactatccaagaagctgatgattattgtccacctctctcatttatattacttttggagcttacaatgccggttcccatagatggaataatcatacctcgtgagagtacacactatttttgcacatttctgatgaagattccaaccccgattccccttcggcttcctctggatctaactgcactccgagtacgtagttcatctcgcagtgcttgctgtggatggttagatcatgagtagtagggtgaagggcgaattcttatgagttatggctttaattagggttttatttttgcatttatctgaacaattctgatggtttttatgctggttgtcgatttagacttggattgtttatgtgaatgacaagcatgcattaagtttggcggcaacgattcgaatgagtatgcttgtaattgttatttgatcccaatttctttcactctgtggtacccatttgggcgatgttcaaattttcgtgatcgatca

SEQ ID NO: 6336 - DNA, 1127 bp, Glycine max
  Soy_ogl_2601 Gm08:10788501..10789627 Cluster 28
aagaacgaccaaaaagtaaattatcgttaaaatgttcagtcgagataataatgcatgcatgggatattatataattccacaaaatcattgattaccaagtgacaatgttttcccacaattcatatcactatggcttttcttggttgaaagagacagttcaatattaatgcttatattccatgcaaggttttattataattaagcacttttgcggcaaatcattaaatgcatgcagcatttggtggtcatcttttccgttgtgtttctagctgagtaagtatgggcatgttatgaactgaattctgaaccctcccttcggaaaattaactgcttgcccatccctttaattaaagtgtccagccacaaacggaaaatttgtacgttcccatacagttattttcaaaaaattaaataaataaattatagcataccaccgaactgtcaatttgtattaaattaaaaaaaaatatttatttttatttatatatggtcataaattatatttgtcgtccgatttgctaataataataaaaaattgtcgtccgactaaaactaaactttgaacttcataaaaaaaaatgttctaaaaaaattaaaattgtattttataatataactatgtcttgttttgttttttatttgtcatcccacatcttgggtttttgtgtctttatttttttttttttatgtgtgaaacaaaggcatgttatattctcatacttctaacagatataagtttgatcaactgtgattgggaaaaggtgaaaggagaagaaagaaagaaaagattgcggatttgaatcctccaaaaatattcccatacctctatttgattttcccattagaccttcttttttttttttacaaaaaatatctttgatgaaaataaattttccttgtatatattggcataacaaaaaatagttttgtcagatctacttcccaaagaaaaaaacaccttcagagaagaagcaacgaaggtgcaaaaattcacgtggagggaagtcaatggaaaataagaaagaacaatgctcgaagaagaaaaagtgagaagacgtttgaactttgaagaaaatgagaaggtgggaaagggcaaatccaaagatatattaaaagagggggctttg

SEQ ID NO: 6337 - DNA, 1200 bp, Glycine max
  Soy_ogl_2704 Gm08:15532501..15533700 Cluster 28
ataattaaaaaaatgtaaaaattacaaatagtagcttctaaccaaatcaacttcaatatgcaaaacagattcacgaagtgtatgtttgtgtaattcaaacacacactaagtcatcaccacaaagtgacccaacccacattattgatgttaagtgtacagtattttttttttcttttcaaaatgagtaaccgatcaatatataagtgacaataacttatatgtttgcgacattaaagttttgtcacttaagaaaaatacatgaaagttttgtattaaataataacgttcaatctatctatctgatttgtttcaatatttaacatttcttttgtgtaatttgattcataacttttaggtgagttttgtatgaaaataaacaagtcaattaagtcgtttacaatcttgcaagaacgtatagattttattctaattcacaaacctttacttatgttcctgattaatcaatccttttattattaatgaaatggtgtatgatcatgtttttttttctattttatctttttcctcccctgaaaatggagtaaacgttgaacattatttattgatggttatatttatgtggcacatgagatgagagagacgggatcctcttccctatcacttgtccttttcacccttcacgggtgtgtgggctatgcatatgcctacctataataatgcaatgtaaaattgccgtgtgattgtgctcatgaaaatgagattttcagatatgcatagtgatctttctcagaggggtccactttcttgccagaccaaacacatcacaaccatacatacacgtacgtgggatttatattgtacagtgtacactacccccatccataaacttaacaaacctcaaaatcgttgttaaatctaccaataacatttgcataagtgataaagatttgtaatcaactatttcaggtttaaattttagttggtctttaaataagaaataaatcatattagaagaagaaaaatattaatttataaactcataatcaactataatgaaggcttaacaatatagtaacattcaaacaagtactacaatttaccataaatatttaaattaatcgttaatatgagtaatttagataattttatttgtaatataactcagagaattgaactaaaaccaatcctttatttaataattgttttgacaaattgacaatggagtggaaagcacctgaa

SEQ ID NO: 6338 - DNA, 2000 bp, Glycine max
  Soy_ogl_2744 Gm08:17260901..17262900 Cluster 28
tgccattttaaatgattaaagtattacgcatcaccgaatcagcttttgagggatctgtatcaaaacagttacttcgatcttctgttgcaaaaatccttcaatatgagtataccagttttcttatcatgatttttcagtgagcctaagtaatttgtatgccttactgttgataagaatttttaatatctagtatagttcctagtaatagcattgaactaaaacagtttttagctgtatagtgtattacagaatacagggtttgatttatgctacttaacgaattgttctttagacttataggatttgatttgaccttgagatatgatttctaaagaatatgatctcagatgtttcaggggggctcatgctgcaaacacctctattcaaaacattttatctagtgcttgagaattgaagctaccgatgacagataaatagcatacccgtataaccattttattgtttctagaaattttccattcaaaatatgatgatgtctacagtttcggtattttccttctagaacttgccagtggcagaagaccggttgtaaagcttagttccacggtgaagcaatcaatagttgattgggcgttgccattggtttgtaagaagaaattcagtgaacttgctgatccaagactaaatggtaactatgtggaggaagagcttagaagagttgcgttaattagttgcacttgtatgtgctcaggttctatctgggaagagacaaaccatgcttgatgtggtagagctactgaagggagaatctaaagataaattttcagaagtccgttgaagacagtttagacttatttcataatattttatctgtacataataaagaaaagagaatccaacaaaaaaaacaggacctgtctgcttcattatacgaggaggattgataaaattgattttacaaaattgataagtgacgtgatttatattgaatttttttatcttatctaaactatcaaagttatttttaactcataatcaaatttaaaatattttctagagtgaaatcaaacatataaaaattgatctaaaattaatcttgtactcataatcaatttcctaaagtaaaaccaaacacacaccaacaatgcttgctgagaacaaaaaaaaatgttttaaacttttaataatattataattatttgggtcagtggaaatttgtagcactaggatggtgtgggttcctagttccatcattaggtcgaactggttaaggttcggttagtacagtgcaagctttacttttggatccaggggagtggttatttacaaatagcaaaatcgaaatcacgttaccctaactcaccactaaggtggggattacgttttaacatctttaaatcactaaaaaagtgaaaaacatgccaaccaggcaggtagatacaccaagtcatctaaacatctcttatttgtgtcacggggaagttatgagcgctattgatttgaaaatcatgcacctatttctgacacaccgttggaagatatcagcagaatcaccttagacagttaggcccacaatcattcaacctgtgttgaggaagagaaactattagatagtctagaaagaccacgagtcctgttagttctctgtaattaaaaatttgaatacatgtcatgcaaaaattggttggaactatggacacatgatgagtcatcttggtaatttcttgttgaagacattctgattatggctttagttgaacatttccatcacccaattactttcccgttaaaaaaaaagacatttatgaacatgcaaagactcaaaagatgtggttaacttgaattgagttgagggagattaagcaaatgtttggtatgaagtgtggcatatgatgattcggacttagttgtctggtggcccagactgttgaataagtatctgttcttgatatgagattaacttgacctgaactctacaatttcaatttgcaaaaaaaatggtgtggctacctgcagagattctgatgactaacttaaca

SEQ ID NO: 6339 - DNA, 1400 bp, Glycine max
  Soy_ogl_3839 Gm11:10848801..10850200 Cluster 28
gaaatagtaaataacttttttctttttgccaaaaaaattcataccatcttttctttctatctctttttttagctttaactgaaaatgcatcaataggcaccccttgaacaacatcacgctcaatcttcttccgccaaataaacctacaacacatagtagtggaggtaagagatgaagcaatccatatgctttcgtagttaagaggcttgggacactatttgggtgtcaagagtacattgttagtgttttttataacatgttgagcgcttacattaatgtgaagaatgaagacatatgaatatatttcttaccagttttaggaggaagaacaatccaattccctctagtgccatgcttctagatgtaccccttcaactttgagtctttttcttttgaccatggtccagtagtagattcaatgtcgaatttctaatattaagtgatcaataatattgattcaacattccatacattagtactaataaaacaatttcaagaatacatatcatacaaacataaaaatagactttcatctaacgtgaaactttaactaacaagtttttccaacaattcagcagatatattacaaaaatacaactcaacaatcaaaatttattcctacacaaaaaaaaaaacttggtatgttgatttcaaaagcaaaataagaaaaaaatgatagaacaccagttgataacttgaagaatagtattattaaatcatacaaaatacagaagaatttgctgtcccagagtaaaaaagactcttggatgtgttcactgtccaaattaccagataacacatctatcccctattccctaattacacgcataattaataaaatgaaatcgatccaaactatcaaccctaaactatcaacataatagtgttactattcatttcaacatattctaataatacataacccctaaactattgttcgtttgtttccataaaaatacattaccctgaaatttaattttaactgacaaggttttccaaagattaactcccttgttttgtatacacccttcaccccctaattcaaaaaatcatgtttcaatcaaagatccaataaaaaaatccacaatcactatgcaattgaggcatgcaacgatattaattttgaggtgttgccattcaggttatggcggtgctgcacgttttggtgcacgagagtgacagtcgggtgttgcgagagtgacgacggggtgtgctgtcatgaggggtgtggcttaagggttctagggtttggagaatgaaaactctaacaaaggggaacaaagagaaatgtgtattgtttctgggttttggaacggatataagtttctagaattctaattttaatttactaaaaacaacattttaatttagttataaattgaagtaatttaaaaagataa

SEQ ID NO: 6340 - DNA, 1524 bp, Glycine max
  Soy_ogl_4187 Gm13:21516119..21517642 Cluster 28
cctcacattaaccacgcgaatcaaatttacatcattttgaaatgtgagtttgttcctcactaattgaaccaataccttgatttttatgagatacagaaagaaacatccttaactgtgatatagtacaaaaggatgatggggaagtgttagtttttgctgagtattttagatgttatttctatttactgtgttataggcattgtagtgacatgtagcaattttgtttcctacagtgcagccaatgaatgactcttggtaatagtataaaagcagttatatggaatgaaaaaaggcaagaaaataagtttttcaattccttttgttaattcccgaaggcccccttaacctcaacctcggttgtagctatcaacttgatccttttgttgagagacactcaccatgtctgatcataatactagttccaaagtagttgatgactgctttaatcgatgccatctttgtagaggtcaagctcttgttgaaatgtattttaatcttagcaaatttacaagtattataaacttatactagcgataatttttcttgagaatccgattaaagtacaatacttgtcaatacactgaagaccaagggcatgaataatcaagtttcgtccttggtgatctttcttacaggcatcccaaatattgaacatatagattttgccctttgttagacggagcattatagtaacctaattaaccgagcatcccaaaggaaatgttgagctgttactgcggtgcttggcaggtcaatgcaatggagaaagttgacaataataatattctatcaagtaattattatttattttaaatattttaacaaatgggattttcatatacaaaagtatagctggacccccttatatttttgtttccccactatccagtgaagatatttttggttgtggcattttgaattggtcttgtttgatgtgtgcgccgcaatcctttaccagctactaattattttgttttcttggattggatatgactttgaagtaagtctgcttttttgtccttttcattagtaaactctcttttgaaccattgctgcatactacaagccatcaaacttccactttactcgttcgagtctaatgatgtttcctcgaaggtaaatggtttaattttataggaaaagtatggaagtatggatttataataataaaattttttgtaagaaataattattggtgctaaaataaaatacacacacataaatatattaaattgggcaatattgaaattcattttttcaaattttattcattcattataactccgtgttttacattttttatgttattttattttatttcaaaagatctaaatccttatttaagtatacagtgtttatctactgacgtgagtattcaagtttttcccttggtggtgatgttcactactgaacaaagtcaaagtgattccaaaatttagaatattaccccttcgaagtcaaaattttcatcaaacacgggatagacgacgcgcatagaattattttccaagtcttcttatagga

SEQ ID NO: 6341 - DNA, 1000 bp, Glycine max
  Soy_ogl_5927 Gm18:4832901..4833900 Cluster 28
ggagccaagaagtgcagttcaaatgtttttcccaaacttcttcaccatcatttcttcctctgctcatcaattgctaagccttgtaggcttcattcgtatgcaagtaacatcataagccctcacacaccatcacctttgtgaaccaaagaagtgtaattcaaatgttttttccaagcttcttcaccatcccttctgctggtcatcaatggcaagacactatggacattatttggctccaagctattaatggaacaaacatcaatttccctgcttactcttgccagctgaaatagcttctttccatatcccaagtgcagctcaaataaccctgcatttgcctctgatgcagggaaacattttggccgggttcctacttactggtcttgtttctatttacatcctggctattcctcttgattggttcaacgcttgggttaatcggttatggtgtgcagtatctcttcataaatatggttggttatgaagcttgggaaaaacattggaaatgcacttcttggctcctagtgggatcatagaacacaaatgtactaacatagcattggatcttcaattcagtccacattctagtagcgtggtgttggtgtgccatggttggagttggctctttgctattttctagcaatggaagaaagggaacttgagagaggactccgtgcatttgttgtatgtgagaacctgatcgtcttttctacgatgagtatgaggtgttcttgtaaagggtgattttgaatgaggaatgtgtgcatgcatgcgtgtctagatcgagaaagagtgtgccttccttcaatgcatgtggcatcagtggggagagaacaggtgagagaaaaatattaaatgagaatgattctttaatctttatgacatgtaacgtgtggaatgtgtgtgatacgtcatacgtgagtattagcgatgaaaaaagaaaaggtgagggttatgtgaaaaaaattcaaatgtatcaaaccaattcatatttaatcca

SEQ ID NO: 6342 - DNA, 1000 bp, Glycine max
  Soy_ogl_1867 Gm06:8800401..8801400 Cluster 28
taaccataaggaatggcaatggagaaattagaaaagtgaaacattatccacaatccagcaattacaaagattaaaaaaatgggacattaagtccaccatcactgccataaacatacccaccaaaattaatgtgacagtgtataaaccattaaaaccaacaaacaaaaaagggaattgcttgaaatttaatcgggagttcttgatgctaaaacataccgtgtaatgtttttccaatctccctagccaaaacctacgtagcttatagatgtccatatacacttttaattaaaaattgaaacattcaaaaatcttgaaaccaagaagctaatagctagtattatttacatatagattttttacaagtaaactaaaatttattaaaaaaaacagaacatagatgaatattagcacaagaactgccataattcagcatacttgtctgttacttttgctctcataaagagataaaaaaaaaggtgatgcaaacaaagaattacagcaccaacaaaaataagtgactataacatgatgaaaaaacatacagcaaaacccacccctactgcaaaccatcaaacaacaaagtccccgaacatgtatactatgatattacgaacagtggcaaataataaggtagccacataagaattcatgtcactttgaagcagcaattcaatcatgccacaccattatttatagtatattataaaatatacacacatatacaatcttctaccttagtcccctaaaacacgagcaagttgttctggatgtcgtagcccatcttttccaaattcggctgcaccgtgaactgaatcatggggggtggtccacaagtcaacgccaaggtatcaggagatgcgtttggaatatgctccttcatgatactttccgtgatgtaccccacactgtattcccacccttctcttatgctttctcgtaccacgtaccacaccttcaacctgtcatgcttcttagcccactcatcaagctcttccctcag

SEQ ID NO: 6343 - DNA, 1400 bp, Glycine max
  Soy_ogl_4186 Gm13:21494501..21495900 Cluster 28
ttatatccccacatacacgttttttttctccccctcaagatccttttgttaggtatgtgtttcagcaattcactattaacacgttcttactattgttggatgaaattttatgagaactagctagcatttaattactttaaagtttaaatatacgggacaaatatctttttatgtaattatttaattatatgcattcaaattaagttgttattttctttctatcaatcagattaatataaaaaaatgataaaaatgacatttaggtttatttaaattttaaaattagtataattatatcaatagtgtttaattatttcttaaaaaatagtatctaattattaagacaaaattacttctggtaaaaaaaaaagacaactttagttcttttttaattatctcattatttctagtagtgttaaagtgacttccaatatgtgagccgatcaaacccaacttcacccatggcttcatgggctataattttccacattgttagcatgcaaaacagtaccagtctcaataaaattctctattgaaactcaaacgaaagactggacataccttttatttaaacttttcatataaacaaaagttaattttgtattttaattattttttatcacttagtcgcaactcgcaaattagaaaaaccggtattacacaaaccatattattgggctagaccatatttagggggcccattctttttataataattgaaataaacttcaaacctcgaaggtgatcattgccccactaggtcacccctccctccatctccctcttatgatactatagaagcctcaactttgtttcatcttatagcaaaaaaatactttgtttcatcttctcggcgaatatcttgtaatagttagagagaaaaaaaaaatattaatagcatcttgaaaatggcaagaaattctactcaaataagtaggggaatggaaaggtacggaaattcgagggaagacttaaggaccactatttcaattgaggcctcacatggaagagccgtgcgtgcctaaagatcacaaaggaccctagttaggaaaagaagatagttcgtatcaatttagatgccctaattccttgtagctacttaggttggaaaatgcccattttattgcttcttgttctaggtcgtagcgtggtatgctagcatgggttttttccacttgatagatgaaaattagtgactactagtggtaaaaaaacaataaagaaaacacttttgttacaccaaaattgccatatgggatagatatggactgtcttcttctttattttttttttcaattctccctttttgtttgtttaggggttggactcacttttattgtgcttactttgtttagacaggttaagagttgaaacccatgtaagcatttggttcctctgcc

SEQ ID NO: 6344 - DNA, 1068 bp, Glycine max
  Soy_ogl_5572 Gm17:7798901..7799968 Cluster 28
tcccctcttgtccccacattgttaaaccttcattaattaattttctttatctgaatgtagttgaaaacataccctttttcttaagaggaaggacaaagccccgtacttgaaacatttttgtacgttacctgtataatttccactcataaagttaacaataactatacgctcttatttcataataatggtttttggtccctgaattagtaaaggtgcttcaacttttgtttctgaaagcagaaaaataaataataaaaagaaactctgaattttctttcacgttagtacttaagtacgtagatctttcttaactaacttcattagaggtgatgaattggcacattaaatgccactatccatccacgaggccccatgtaaacaaggactaaaatgagagtgtctttataaaggttaaattaatttttgattcctaatttattatttttggttcgtttgttttggattcaatttgtttctttaattttaagagtttaacttcattctcaccgatcattctaatgctgttaaatttatgtcatttgttatttgtttggtagattccaccattaacaattttgatggaaaatttaatctatttcttttttttcatattacttttgctatgaaatttatctaaatcagttgctttcagttctctgtcttatacagtagtatatcgttatcatagttaaaaatcgttatcatgtcaacagaaaaaactagaaactacaaccacaacaaaaaggccgtgcaccaccatgtgacatcttctgttctctcatttgaacctttgggttcgggtcattttcataagtttgaagcacacattttgcagaggccaggattaccgaagaaagccatgcatggggcattggttgaaggaacccaaccaatgaggttgttatcccaaaaatgaaaaattcaaacacacaactgactagaagaagcgttttgagggaatctagaatggcgttggtgaagcggttgtgagaaaggttgagtgttccgacaagggaagagagaacagtgagaaaagttaataatgtttgtgtttggatggtggatttg

SEQ ID NO: 6345 - DNA, 1500 bp, Glycine max
  Soy_ogl_5969 Gm18:6658101..6659600 Cluster 28
ttgtgcatacaggattgcctcatgttttttctcaatgattctcttcgtgggtacaattcaatatatttaagaaacaactcaactaaatcaataacaatataaaacaagatttaaagacattaggcctttcttggtgttaagaaaaagaaaaagaaaaagccaaggaaggagtcaacattcaacgttggggatcgattatgcataaaaaagatttaaacatatttttcatatataaaaaatattttatattttaacgtattaattttaagaaatgacatgacatatataaagtatcatatcataagcataaccacttaacaaatagtaaaattaaaatcatgtcattatttataatttatttttcttttcaaaaattcaaattattataattcattaactaataatttttatttttttaaaaaaaaacttgctcacctcctggagaacgggaatgacgaccagaccaagtcctggagaacatcctggaaagcgtgctccacttcctcacctcccaccccgaccgcaacgccgccccactggtgttcaagtcctggtacgacgtcgaggccctctcacccactccgaccccttcatcggcaactactacaccatgtccccctggcgcaccaccacccgcttcccccatgttcgacctcatgccccttaactgggggacccacttcaccccttgggccaccacactccaccccaatctatctatatattttaattaatttacttttcttttttttgtttgatttagaggagagaaataaaacaaaaaaaaattgaattaaaatgcgttaaagtataactttattttcgacttcatatgatgccctttgaagccaaataaatgatggagcttggtgtcttttacagcaaatatataactcctattatactacaataacaaggttttaatctaacactcagtataaactatccaaacttttcagaatataaatacatatatatataaagaaaagtacccacgagcaaaactaataataaaatcacaacttatttatgggaggtcacacacgaaccataacatgacgaacaccagcacacatacaccaggcttttcttacaaatactattacacctcttcttccggcggctgcatctcatgatcagcaaagatcttaagaatatcattgaagaagcataagaaagctacgattgaagcaagcatgttgaccatactgtaccagaaaatgtcagcgagaagaacccagacgagtacctcacatccaactattccggacatgtagaatattatgagtgcttgcaagttcgtgtctgcagccatggatgccaggccatggcaagtgatagaggcgacgaaaagggacatggttggagttgataggaagggattggtccctggctctgtatacttaatttgaaccgaacctaacagcaaagtaaacagaataacaaaggctttgccattttccattgtgttgagaggtgtatgtatgtgtattgatttta

SEQ ID NO: 6346 - DNA, 1000 bp, Glycine max
  Soy_ogl_1072 Gm03:43621001..43622000 Cluster 28
ttgttaatttaaagagcaaataaaaagtaaatactacctcttgtgtttttaatatttttaagatgaccaacattttgaaaatcatatagctagctttgattgtccaacaactgagataaacctgatttggatgcaaaacaaatcacctaatcgaaaattgaggaagcacaatttcaacgtgtgattgaagttgggtatgtacatgtacattgttcccactctggtacaggttgcgctagctctcttatcaccatggctcggttcattgcacattaaaaccaattattcgccgggttaattattcttttctacttgggggtgaggtttttaggttaggttacacttttgacttgcccagaacagaacctgtgagctaaaaaaactaacggaataagcttcttctacacacaccctcattagaaatgggtccattggaccctacaagccagtactaatagacatctcccacttttcttcaccaacacatgcatgcagacacgggaagagagacacaaacaaagagataatgaccaccagttaaaattttagttttgttatgtagtttgattcctttatatatgcatgtgtttaacaaatttccgcccccgaattttgacgatttgcaccgaaatcattattaacaaagctttagtttgttaaccttttcatggaagctttagtttataaaaaaattctttagtttttattccttaaaaatttaaaattttatttttcgtttctactattatataaaactcgttaactagttatctgacgtgaagggaatgacagtggtgggtggagatgtaccaccggaggtgaaggagtgattgttggaaataggtcaaagatgaaggttagaaccatggagtacgaatttcttgaggtcaatgtataacaagtttatacaatgtagatttatctaatgaatgtaaagagtgatgcatgatgaatcacatgaccaactggtccaagttgaaatcgatcttcaataagcgtg

SEQ ID NO: 6347 - DNA, 1100 bp, Glycine max
  Soy_ogl_1393 Gm04:44292101..44293200 Cluster 28
attttacaactagaattgccacataacataaaatttgctctagcacaatctcgttttattggtcctacgggaaagtttgagcaaaagagtattttgattacaataataaaatgtcgaaccatttgctaatttaaagaaagggtactcaaaatgaaaagctttccatctttgtatcgtaacaactagtgaccactttacttccaaaggaaacaaccaacatttagaagtcttgtttttttgtttcattatgcaatggtggcattgttgcaacatatataaaaaggaccttcatagaggttttgaaccatacatgtatagtctttagaacaagaaaccttaacacaaggaataatgaccacgtctagggtaggggaccttaacaaatctcccaccataggaaatttgatgcttacaattaataatgttcttgatataaatgtaggactattgtgtggatctccacattggattaaattaaaaaataaaaatgaaaaattggtttcggcctctaccaccaaatctccatgatgtcattgacattgttatagcgcaggtgctccaatgccaccccaacaacaaaaaccaccttctagtgctgccacaacatgaaaaaactttgtagacgttatcgcaccaaaacccaacacctctactacctgccccttgcttgcatcaactacaatccccttctccatgaaaaaggccccaacaaaccttttgccaacaaccttaacaccaatgccatcaacaaacaaaaatatattttttacacttttatttggtaacttagatatgaaaacttcaaaaacattccacaccacaaacaaaataattatttttcaaagacaatttccatcatcaacaattttagatctaaaaaagataaggccaaagctagaatcgcattgtaaggaatcttaatgtgactgcaccattatcaacacaccacaactgtaaatgcgactccactgtcaacgcggctccaccgtcactgcagtgatccttaatggtagagaagaagaaaaacacaaacataaggatgaaaaggcaagttcatttcgttcactggtgattacaggcaatcaacctctaaaggttga

SEQ ID NO: 6348 - DNA, 1200 bp, Glycine max
  Soy_ogl_2559 Gm08:8341701..8342900 Cluster 28
cactaatggaaaataggtactgctaccccttcaacattgcacaggaaaaataattaaattaattggcaaaagatcggatataataattaacaagagatggctagcactaattagaccacatggtttcagttatgtttctcttggcaaagccttcacattgcaaagttagtaaatagccatgtcatgtgccaatgtcaaacttaaaaaactgagggctgtagatttgtgaagcttgacaaaatggcctttgaaagcaatattgatatgtttgttgaacaatagatatgtccaagcatgctatgctatagcctataggtaatggtaggccacttccaacaacaactatccaagtgagcatttatgctttggtgcccctaggggatccacactccatactctactcaagagcacttgtgggcctcatattttatagtgttagtatagaaagagtacccaatttacccaccctccccatctcagtctttttcaacaacaaaaagagaggggaaaggaaataaattatttttcaactctttactctttttttgtcatttttgtttaattagatgaagatttttattttatcatttttattggaaaatttgatcacatctgcattaactagttagttccctttgcctatctgaatttagatttttattttacaatataagccagtgttcctctgacagataatgaggtcagcaactattttctacactgtagctttttcttgttattatccacagcagcaagtgtttcactgtttcggcaggcaaagcaaaggggggtctatcaggcttttggaatgaaagctttttgggcctaagatgacagacaaaatatgatgatatttaaggagggatggcaacaaagcgatttaagaattgggtataatgcataaaattcaattaacaaatcttaaaactaagagacttaggaactaaattttatttttttagtataatatgtaattttaatgttattattaattattgctatagtttaatttagaattatttttctgttaaacaatagtcaccatatgaaattcttaatgttattatataagcaatatatgtatttataaaataatcaagtatttttatttaattgaatatgtcaattagtgtattatgattttctacttacattacttttgtaaaacttaattctaaaaataatgttaagttgagaagc

SEQ ID NO: 6349 - DNA, 1000 bp, Glycine max
  Soy_ogl_3183 Gm09:38951201..38952200 Cluster 28
atctatttttaaatgtagctagccaattttaatcaatgtcttctcttgaccatagaggttaaaggccatcttataattcatgcggttaagaagaatatgaaaattttaaaattaatccttgaaacaccttcttatgacatggcatccgcaacaatttctaccctttatattgaatcccttctgtcgattgatcctttagaaagagcataattaatgtgacaatggagtcgtatttaatagtatttgaaacactagtaccctttatattgcatctcttcgtaaccatgctgtttcttccagaagcaaataagccattgattttgcattgaactttcaatttgtcctgcagcaaaacaaaccagcaaaaatattctaaaaagtattctaatcctaacgaaaataaaacaaattttcaaatttctatttattaagtttaaattaaaaaagataaatgaattgaacgaaagcaaaaaagacttatcaatatatgtgtgtaccacggtgaataacagctacattttgcctgtgtgacattgtattaaaatatcatagttatctatattaattcgttgtctacaacaaggagcgtgtgaaaaaattattgtaaggtctaggaccattaatccattatgattccgaccattttttggtactaacaagtaatcgagccttattaattctgtttcataaactaaaaaattgattatagtatgtcatgcaaagattaatcacaactataaataaatatgtgatattgtgatggtttgtcctaaggtgaggcatcgtgggatggtttgggtttcatgtgaatggatcaccagaaaaattattgatagtcataaatcaagattttctcaccaaattaagggttaggatcctctccatttcttactcttctaagccaacaagttcattggatccttttattttagcgccaactagtttttttttttcacttttaacagagcaaaacaaaagaatcttaacaaaatattatgta

SEQ ID NO: 6350 - DNA, 1100 bp, Glycine max
  Soy_ogl_3249 Gm09:40917001..40918100 Cluster 28
tcttccattgcagtgagggatctaaggggagaacacagtaacactctatgctcctctataaatgagatgcaactcttgaaggcactagttattatggcagaagatggctatggcgtaaatcacttaattgacttgcactctgtgtcatccttgtctacacttaggaagcttgtcctgcaaggaaagttaaccaacgatccattgaaatcgctaaaagatatgccaaatttgttgtgttcctctctttggaattacatgcttatgaaggtggaactttacattttcaaatgggagggttcccagaactaaaggaactagtgctcaaacgattgtataacttgaaatcaatcgttattgataaagtagggctacaatctttgaaaaagcttcggttagagaaaatctacaacctcaagagtaccccgtggcattcaacacttggtgaaacttgaaaatctcactctctggggtgtgccaactgaagttaagcagagcattgatcccaatggaggacaagagcattggatgatccaacatgtgcctagcgttgctattgctgattcgtttatggtccagagattagaagaatttctagaggaggaaaggatgaggatattaggatttagaagatatgttctttcctcttgttaatatttctatagattgataattttgtcccttattcttttttcaattataaaaatgaaactgtttcctaattactaatctgatttctttacttttgtctcccttccattacttttctttgtctacatatctcccgtgtctcatagaagttagagataaaattgtcttatagctaaaaagaaattacaaggtattggtacggaccttcaacaacaattgtaacgtccacaaattttccattcttctcaagttattctatttgctccttccccaaacatgagacttaattttatttaaatttcatccatacttgccgtcagaaaattacctcacctgtagataatccatcctgtgtgctcaataacttgtcctattgatatgagtgcaattgttgcttccttttttctttttttttttttatcgagaaatgttagttgttaaattgttagttt

SEQ ID NO: 6351 - DNA, 1000 bp, Glycine max
  Soy_ogl_3277 Gm10:244101..245100 Cluster 28
ctgtaatttcttcttcagtgtactaaaggactatcaaattttaaaagtagataagtgaaacgtatatatcaaactataagtaaaagttgaaacttatttgctacatttttctcagttatttcttgtttactgaaaattaatggtgacagtcttgagcttgaaaacatctgagtacaatgcttgagatatttgaaatttgaaaacatcatgaagctcctaacattacaatgataattgacacattaatgtactgaaaattgcttcctaagtgaggtctcatgaacaattgtgaatacatccacaactgacacctcaaatgttcatattatcaaattaaaatgccagttgtgatatattgtgtgtgcgaatttcatgtaataaaacattatgattaccagaacatatttaagggaaaggaaaaataaaccattagatagaatgcatgcattcaattaattaagaattatgttacctttggtataaaaaaataaaaaattaagttacctgtacatacatatcacaagcagaaattacatggacttgagtcgcataacagactcttcctatatacacaaattacataaacgatcatttcaccttgttttccctctcttccttctgtgcgtgtgtatgtaatgcttgtctagaaaaaagtctctgtcaatagtttttcccttctattaaagggtcatagactaataatcatagagtacaacagcatgtgtaagttaaaaagtaaacactacaatttagaaaatttccaaaactgctcccatgttaatatgttatcctttctatttcacaaaccactaagattttctccatatatcagctagaaaaaaatatgaagttcaataccacatggattttacagtaaaaaaagaatgggccactcgaggtaatgactattatggactagaagccaatctagaaaagagccacaggtacatgtctataagagtcatactggtcaactacttcctgcacctcccatttgctt

SEQ ID NO: 6352 - DNA, 1000 bp, Glycine max
  Soy_ogl_5273 Gm16:3528301..3529300 Cluster 28
ctacttcgcggtaacagctaccaaaaaacaaggcagaaagaaagaaaaatacatgacatcttttaaattaaaaatgttcgaattattttgtcggtgttgttggttgcaaaacaatgtgtcacagtacacaaacacatatggtaccaacaatcagaatagaggttcaacagaaaaaagcattttaggtaaaagaatgcttagaaattgtaataggcaagtgtggtttcaatggttcaccatgttatgacccaccaatagaagcggcagaatcaagcaacaaagaggcaactcgccgtgtaattgagagctttatcgtatagcataagagggagggttatgcaaaagggtgggaatattttgcacacccacttgttcccacatcattttcccattgtcttcctttttcttccttttaccttttgctttcaaaaaagatagagggtcattttctcaggaattttaagaggatcaaagttcaattcaaacctttcatgattgggaagtcggtgcaatgtgattttgaaggaaattgaataaatagatattttgatactatcttatggacccaaaagatggatagagtcataaatctgagaacattcgtaataagttgaggtgggtcctaaatattaataaataagaaaagcagggtttcacactgaagcaaaaaggattaaaatatatacattatttgattttaactagatgtagactaaattactaattcgatcctctgtttatttgttttattcaatttgtatcttttttttattaaatgttcaacttagtcccttattttttttttaaatatttcaatgcagcccttttcaagatcaaataaacaactattttagagaatttactcataacctgtcatttggggtttgttaaacttctttacttaattttttttaagcctcacaaaccacaccatttaagtgttctcacaaacttctttacttaattttttttaagcctcacaaactacaccatttaagtg

SEQ ID NO: 6353 - DNA, 1200 bp, Glycine max
  Soy_ogl_6228 Gm18:57307401..57308600 Cluster 28
tgtcaggcgttcttgctttgattcagaaggagcttagcaacttcaaattgtactcctatgcagatgatgaaggtaactataccagcattcatttatttcttattattttacatgtttgttcttgatggtatttatattagtaactgtatttgggtaaggggtgtatgatgtgcatgtttggttttgcgttttagctgcaagtgtatctccgcagatactacaatttgtagcttctgcattaagtggttatgttgcagaacgtatgtattttaggctgaaactaaaatacacaattactgctattgtttggttggaattagactagtgttctatatattgcacagtaattgagatcgtgaccacttttttatcgttattttctggaccaaaaattgaaaattagtgtagtaattgcttgtttgtttggacttttcttagatctagattctcccatggacttgtcatttgagagaaggctttctgcaaaggcatttgttgcttaagtctttgtttctcccatgttcttctgttctgtagtttaggattacgtcaattaatggaattgctactattttggttgttgagcaattatgtgcccttaatgaaggctagttgttctagactaggctagaggctcaatcctattagtaggggttactttgcacaaaagcactgcactatttgaaattgtagggctagaacgaagtcaatgcctaaacattgaattcttaagatgtaacctcaatccaaaataaagttaaccatgtcaccatactaaagagtattattgtcaataaaaggcttccggtttcacgttaggaaatcttgcctacctcaaactcatacaaatagaatcaacgatgctatagtagggaaacttttacatttcattgataatatggtaaaattgttattgacttgtgttggaatgttttttgcgggtatcaacttctttcatgatcacgatgtctcagctatgctgaagaactacacctacgtcttgtgaccttaaaccacataagggcattctgatcaatgctttcttatagttcaatcaaagttaataatcctatcttgaacacatcactaggcaattgacaaaaagactcgcaataaaggttggacactcatgtcaacattgaaggctgatagcatgaataaatagactcacaataaaggaaagacataatttgttagtaa

SEQ ID NO: 6354 - DNA, 1070 bp, Glycine max
  Soy_ogl_4448 Gm13:34382531..34383600 Cluster 28
atgctgcaagaaatattgagaaattccaagaatgtattatgctgtttttatcaaaacaaatattaattcaatcaaacattattcctagtgatggactctgtcaaacaaacgagtcattgccatgatgcaacactcttgaatttccgcaattacaatacttgaaaagtgtataattgctcaatttttatgccaaaaaaaaggtaataaaatgcaagatttcacataacatccgaccaagtgaaaaaaggtaaaaggtatagagaagcataacctgtcttgatgtggccaagaagttgatctctaggtctttgtatttggaagagaagtccatctcttattatgaatcttaatattttaaaagattaatctttaactttggattataaaatactttaaaaaaataaaataaaatgcataaacacctttcaccaaggagcatgaatccatgatcggcatatcacatattgcaaaaaaacatgattgagtgcagcgtcaataaaaccatttaagcatctacctgagaaacacgaggggtagttgctatttactatttaggacttcatcaacgctgcactcaatgatgtttctccaatatgggggtttacactcacagtactctatgagatcatccatatttctctcttctgcctaatgcatctcttatatcatgtgatatcacgtggacaacgagcttagacaaagcactagaaattatatatatgccaattaacctttactgatttgtactaccttttcagtacttgactagttgtttgcttctcaaatttgtactggtcagttgtactggaatggaatcttgtactgctatttcatctacttagctctagagactttcttttttgctcaagtttaggtctagagagtagaattatatatattatccatataacttatttttgctgaaatttgcatgtaataagcaataataatatatgtagtattatacaatatctttatttgttatacaatatctttataatatatcacatattttactcttttttttttcttttttcctttccatttctttgcactccaaaatggagtgt

SEQ ID NO: 6355 - DNA, 1010 bp, Glycine max
  Soy_ogl_6242 Gm18:58123401..58124410 Cluster 28
tacaaaataatcattctcagagcttggctgcattcaaggtaggaaggggttggccatttaggtagaggaagggacataacactaccccatgcgtgtatatattcgtcatcagctgcagtgtagatagattccagtttcaattcttgatatttataatcacacaagaaaatacaggtctttgattttgaataaaggtatatcataaatttgcaatgagggtgaatagcgaacaacttcatatccttcatactaacttctctcagaatgtaagcacgccataaaccttcctcaaaattcatgaaataaactgcacatactgaatttaagcttgataatgcacaggtctttaactctcccattgcatatcccagtacacacatcccattgcaatgcagtatcaattgtctgtatgtgactcgcccaatcaattgctcctgggtgttatttttcgcgcttcttctatcacttgtctatttgtgacttgtgcattgtctatcggttaaatataacatacaaattgtaaataatttatcgtatgttaaaagtgtaaaacatacacaaatgtgtaatttaatagtataactgtatctatatttttgcagtaaaaaaactgtatattttaaataacatgttcatgtgttaaaataaaatattgcaatgtatacatgtgtattttaatattataaattcatttaatatgttaaaaaatacaagtatatacattaaaataaaaataaataaaatatcaattaaatttttaactatgtaagatttaatattcttaatttacttaaaagagattgaatgggtctctaccaagaaagaaaaaagcgtttgaatagaacccttcgcgtgggataaaatttcccatttcccatttccctgtaccacaaggataattggccatttaaagaaaggaaaaaaaagtaataataaagcatggatgaatctggatctgaatgtgaaaggtaagtgaggggagtttccatatggagaatgtctacctgata

SEQ ID NO: 6356 - DNA, 1000 bp, Glycine max
  Soy_ogl_1847 Gm06:8121501..8122500 Cluster 28
tattcttacaacttaaacaaaattttaaaatacaaatatattttttgaaggtaaccaaacatttacaaaattgattttaaagcattgcaaacgaaaaatcaaacacacacataatgaaatataccaatttttctatacaaaaataattagtaattatttttaaaattgataataatttaaagtaaactaaatcttgaaaatgataattatctttttaagaactaaaaaggtgtttattagaaaagaaaaatgctgcaggcaagcaagtgcgaaaaagagatagagaatgagactatagatgaagcgatgtttgtggtagacgcactcttaaataaaggatacaataatacgaccaacagctttttaggcgagctcttgcctttagttttatgttcgggtcctgcttgtaccaaccagattcaattcaatacacgagaatactacttctcaagttaattaaacggtacttatccataatgagatcgaattgaagccctcatttattgatacctttttctccatcttgatacattgatatggctgagactagtcccattcctaatccatttctgtacaatgatttaacatgcatttagttacgtgataatgacatacatcaacgttgttacacacatgccggcaatcactatctcgggtcacattcttctgaaattcaagcttatcattgtaaatgccttgtgacataatctgatcatgctaattggttgataacaatatatatttagaggttggagcttgcacttaataagagaccactgttgtacatggctgctgttaaaaaaaaatgtacttgtatttggggattaagattttcactaaagcatcgatcaaatcgagtgaaaatgggcgtgatactatcacattcacatgcaatgcggggtcctgaatgctccttggtaccaaattaaggtgacatgccttggttgcttctcgtgcaatgattaagtctagctagtgacatttgcaaagcagcactata

SEQ ID NO: 6357 - DNA, 1063 bp, Glycine max
  Soy_ogl_2720 Gm08:16190338..16191400 Cluster 28
gttgaacccaatgcccgacagtgtttggctctctcaaataagtgtagtaacttattgtcccatgacattttgttttgattttattttaccacactaaacataatacgttaattaattaaatctgatataataaaatgtatgtaaatttatttgtatgaattaatggtggtttccctaagctcaagtagtattgctttacttgaaagatacacgtagttggtaaaaaacaaaaattgtcccattaaatactacacaattttactgcagaaaagctgaactcaattctcaaaagcaattatgtgatttaaacaatatattttgaaaattaaaatgcttaaagataaaatgggacatccgtgtgcaaaattttgttttgtcagcagcaatctcatacaagctggattagtatttgagattatgattcgataagttaaaagacactcgtgattttttatgcacgactaacaaattaaatgataaagttttttgaatctcttcgatgaaaattaaaccaggaacgtacatgcggctacagagagactaaaattccgatcatgtgaatctgtggcaatagtaattgtttatacagcagcacacatgcacttttaggcaagggttactaaaattgggtaataaaaaccgataaatagcgagtgctaatctgcattatttccccataaattcaccaaacatcttaatgaaggagtagtcctttcccatccatgatccatgcatgtctcgtgcctgaggactagggcaaccagcatatattaatttaatgtatttattgctgaacgtgtattaccagctggactactctggtgtaaggcgttgaccaaacttataacattaaaaaaaaaacttacaaatctgtaaatggtcacatgcatgcatgtctttgctcataaaataatttaagtgggctacccagctaagaattactcattcatacaagtttgcacactctgttattaattttcttacttcttaatatagaataatgtttaaaatataattttggttttttttcatttcgatctgttttattttaatttaatcctag

SEQ ID NO: 6358 - DNA, 1218 bp, Glycine max
  Soy_ogl_4228 Gm13:23596283..23597500 Cluster 28
cttaaaactttactccaaagtccatatataaaagtttaacatattgtaaataagaactattctaaaatatgtatacaaaaaaaatacaagctgaagtagttgaattggacctagataataaattttcatatttccctcatctatgaattataattaatggagagaacacgtatagggattggtgaaattggatgacagaaacatgcaaccacaaatgcatgtttgaatgtcagatccaagaaccacctggactccaggccagcgaagcttatcgtctcaatattaatgctttccttcctgaaaccgttcctttaaattagattcataaatattgatgataaaaaaatagattcttttacaataagtgatgtataatttcaaattcatttttctgagagtgactaaatccgcttcttcgtcccggagagaaaactataagtgatttttaaaaaatatatttcacctcttttacttttatgatttctttttttaatgaaccaccctgtcacatataaagactgttttcataaataaggttccaagatgtgttgacaaagtcttccgattcctaaaaaaagtggtgttggctacctagtgatattatcattaaagatagaaatggaggtcgaaaagccatccatgtttgatgccaaactaggaacaatcaatgccatcagcaataggaaccccctaaaatacaagagagagaaaaaatgagagattggaaacaaataacaatcatcgtgaaaaaattaggaaaactgatagtttagctaaggcttcttagtttagacatatataagttgtacgaattgatggatcatagggatgaagatcaaatgcataagagagatagatatcatattgatactcatgtggtagcatagtgaagactcttatttatagagcatattatccctaactaacttcctagctaactgactttaacttccaaactgatttgttgattttctataacctctatataagtaccaactgttaaatttacatgtttgttgtatttgttaactcgtgtccattctgataagatagtttgccaaaggatgtttagtgaaatgtatcaatacacacaattttacatgatatccaaactaaaagcttggttctactccaataacctctagctccctttacacctctcataaaatcatgattatagatgaaggagatgatgatacggagaaaacaaaccattga

SEQ ID NO: 6359 - DNA, 1200 bp, Glycine max
  Soy_ogl_6891 Gm20:40618201..40619400 Cluster 28
acgtatgctcttagcttggatacagtgtctagttgccctaaaatgttgtgcatgactcatattttatatgtgggtagatgttggagcagagtgaagtgaagcacaacggagctgaagcatatgctcattgggcttgtgccactagttgtttggttctgacacgggttgaggctgcagggtgaagcccacaacacagtctggataagatattataaaaaaaagaaagtgtcttgctcccttagacgtagacatgttgaacctcattaaatctgttgtggccaagtgtgatttctcttatatcctttagaattctggttattattgctaacaatgatatcgcttaactttggggtctgtcaaattcaaagtaagaaagttcgatagaatgagaatttcagattgtgacaaagataagtaaaaaatttgttgacacaacaagactttctaaaggcattgtgggactcaaaacctgataagatagagacttgggattgggagcagttgaaagagagattacgccaacatacgtttgtgttcggtgaatacacatttcctggctcaactgatcaagaaagaatgagaagggaagcgatgtttagaacttgacagcgaaatgtgttgcttaatgatttaaacacctcttgtgtttaactaactaaagtttcatatagaaaacacaacccgctcctccaatggaacacctcaattaatcaatcgtaaccgtgtcagtattttttttttttttgcttcttcttcctccaatgaaaaggtgccaactcatatattgaatctgtgcactattccgttaatttagcaaggattcacagcgtcaaaatgaaaacacagtcagaactcatagattgttccctctcgcaaggttcactttgggatttggtactcgttattggcattttaacgaatgatatgcgtgctaagtgtgggtataagcgtgctaagtgtgtgtggaaattaatacaattcaggttgaaaaattcaaggtcagtaggcacaattgtgcttagtggttggaggagcttgaagacattgaattgtaatcaagttagattagattccaagaaagagggaagtggaaataatgtctagaatctactttccagtatgaggatattttggaaaattaaatttgaaagaggagtgtattaataaaaagggagagagaaaataaaaattgactagtgc

SEQ ID NO: 6360 - DNA, 1100 bp, Glycine max
  Soy_ogl_3044 Gm09:7665001..7666100 Cluster 28
gtgtgtagctaattctagtgggatccagagttgttgatatgaaatcgtaagcagatcgaccactcctcttcaagcatattacctaaattcatcgaggttataatacttatgagtgtttattttgtaccttggcctgacgacatttttcaacccctctttcgagtggataaaagggatcccatatgaaaaaataaggataggattccttctatccattgaaaagagaagttgagaaatgtcacccagtcaaggggtgaaataatcaaccataagtattattataaaccccaataaatttaggtgacatgcttgatgaggaatggcctgcttacaatttcatatcaattactctggatcatgctagaattagatacacagcccaatgatactatgttttgttacaatatagctgcaacaggaggcattaacgcatcaatgatacatttgatgcagctaatataaaaaataatagtaaagaaaatataaaaaataacataaaaatgcgttgaatttgtttaattaataattaatagtaagaatgtgttgaaaaaaggtgttgatttttttaattaataataaaaatgcagtagtggaatcaaaaggccagatgaagatcaaagaaaacttactgaaaaaccatttgaaaagagtttactctaaatggatttattgaaaacttagttctaacagagcccatagcattatttgattcatgtaccaggccttttataatggaaaaatactatgttgtcgctactcccctctcttcccacacagaactctattatgaaaacatcaaaagaactctcctatatttatattaaaaaaaatataattaaattcccgatacaagcctaacagattcatgagtttgggcactagttcatggatgttctgaggtcaaattccatttctatcatttttagccttttaaattgagaaaaaaaggaaaagcactctcattaacctgtggaaacatataagggagatgaattagatcctacagaaactgttccagaagaaatcccagttgtttcagttgtctaactacctgaccagtgaggaaatggctggcacaacaacttctgctgcttcaggga

SEQ ID NO: 6361 - DNA, 1148 bp, Glycine max
  Soy_ogl_3184 Gm09:39048801..39049948 Cluster 28
aatgtatcaatcaaatgaaacctccatgtagctctagtcgaccagattatatggagtggattcattcggatgacgggcaatttactacccatgatgcttatagtaaactgtcatgtatgctcaatttggaagatttccagctttgcaaaagtatttggcgttggcatgaaccaaaacacattaaatatcttctttgaaaaataggccaataaagtctccccacaaatatgttaaggaaacatcaccatatgactgatggagacactttcctgttatgccatgataaaactgaatccctggcacatgcttttagagattgtacttggatgaagcgaatttggatccatttcaagtttactactaatattttgttctaccaataggatatgagtagttggatgaaaaccaatattcaaagcaataaaaggttagaaaacatccaatggagtgctgcatttggtggagatagaatgagatcatcttccgagatacttggcacaacacaaatgaaattttgtttaaagcctgagcactattaagagatatcaagagtagccaaaatatggataatgtactgaatccgattcatacaaatttgaagacggacaagtctagaatatggaataatcctatagaggggtgaatgaaacttaactgtgatggagcttatcttctagcagtaagagtagcttcaagtggtgttgtcataagaggtaatagtggtagctttgttcgggcttacctagaaggttggggcacaattcaattttagaagcagagctatgggctattttatatggcttgtgacaaagggataacattggtaatggtggaaacaaattcttttaaagctataaaactgttggatgacaaaagtggtgagggggagtgctttaaagaacttgtagctcagatttggaaaatgaaagaaaaattccagctctaggtgttgaaaaatattcacaaagaagcgaataaattagtagattcatttgcaaaacatgaattgtctctacaatctcatgtatgttttgatagcagtgtgcctggttttgtagcccactcgtttaagggggatgccaatgtactaaactcaaatttcaataatgtctaattttgtcttgggtgttttgcctaaacaactcgac

SEQ ID NO: 6362 - DNA, 1000 bp, Glycine max
  Soy_ogl_3688 Gm11:2282601..2283600 Cluster 28
cactcacgctatagacttcaaatcaactggttaacataaatgtaactttgatggggcagtgtcacaattatgaacgaatatattggatctggtgaatctaggcacatctaattggaccaagaagacgaaaatgaaattgttaataatttagttatctcgaaagaatattggcagtatgggcaggcacatgttgtgctggttgggaacattttaattttgatgatatgaacaaaaatttgaagtgataggagggagtaaagaaatgttgctcaatttagagaagacacgaggagctatggccccgtgggaggggccgatcggttgtgttgccaagtaaatatatgttactgttagtgcttcaatgatttgtttcccaactacaaagaatctcctttggaagggaagggaagctatgtggttgattgtatatgtataacgcatacttttgtaaacttgaatttgatttttttttttataatcatgttactgtatgaaatatttattggtttcttttttttttaaatgatatttttttaatcataagtatcaaatctgaaatcttatttaaagaaattaaattcaatatcactcggatgaaaccgcttattaataatatgaatttcatgaatttctctgtcttaatgtttcattattttttttctttccatctatcaatttgcagtcaattatgtgagtgtgtgcgcgtgtatatagtagttggtgggtttgggggggccatcgttcacttcaacatgcccccacgcgttggggaaatccttcaaacgggtagtgatcttggcttttgatgttaatttgaatctccatgcagttgattaaatgcgtctaactgcactgggcgtgattctctagtgtacaaattcgttaaccattgtctcaaattaacaaaaccgcacatagaaattattaacatcacggttcaagtagaagtaagatcatcgtcttactatcttgaattttcgatcaccctcaaaatatggat

SEQ ID NO: 6363 - DNA, 1018 bp, Glycine max
  Soy_ogl_3681 Gm11:1551783..1552800 Cluster 28
gtacatcatagtccagggattgcttgtggcatgcaagaattttatttgatagttaatatcaataaaatgattttcatttctcttctttagagactaaatcagtgctattatcgattgctgaattttctctttcgaaatgatattatactatacatgctttatcaaaaatagttactccagtacactttatcctgatatgtattggattatgctgttaaaatcaatttgttatgtgatcatacttgttgcaaaaatcaatatgtagatgtgtctattgccgtttacaaaaacctctggctgaatttttcctatgttttagttgttctgatttttttttattcttaccatggaatttttcataaatctaaagcatgttttcttcaatcattgcagggacgccatggtagctatagaatacatgcgtggaccttttgcacttgcattgctgcctgcaaaatgcaggttctggcaaatatactcgattgatggatcgcatattcacattcacgggtagtgtctaatgcctttaatttttatattgtattgaatacgttaagttgattttttattcttggacttcatctattttttaatttttcgttttctcttagagtggggagacttgtaaatgtaagaaaaattattaatgaaatgaatacttgaaacaggtttattggcgactttaacacctaagaaacaagagaagaatgaagctgacgaaacagggctagctactaaagagatgattgacccaatagtcgtatatagcaggcttccacctcttataggaccgttgctttgctctctcgttgttagaaacatggtggaaccgtggctctgatgaagatggcaagtgatgtgatgaaatagtctgatccttacttgaagaaagaagccccatagctttatgtagccttctaggggtggatgaagccaaggcgcaacaaatatattgtaaactctcaatatccttgttagtattacattaggacttcttaagaaccctacaagagcacgc

SEQ ID NO: 6364 - DNA, 1000 bp, Glycine max
  Soy_ogl_5379 Gm16:30692301..30693300 Cluster 28
tattaggattagtgtccaagttttcccataacttctcgtttctttgtttccatatacaccagagcatcattgcaaatttttgttgatgttgtgatggtaggatttgcagaactttgaagatgagatcctttgtattttgggcctggtcaaccttgtcagaaacccgcagcctcctaaatctgcttagcttgatggcagccaaagaaaatgtgatattcgatcgtcctcaaggcatccttcacagtaacaattgatacctccttcaggaaaatatttagctttgtaaattttgtaactgtagcatttgggtgagtgatgagtttccacccctggtttcctagcatggataggttgaaaccatgtaaattatgaaagcccaagcctccaaactcctccttcatagataacttgtcccaactaagccaattgatacctcttgatgttgcagttttcgaatcccaccaaaaggagttcttcattctctgaatgtcttcctcaagaaacgctggaagtaagtagacactcatgcaataagatgagattgcttgagcacatgatttaatcagaacttccttactagcctctgagagttgtttccctgaccaatggtcgatgcacttccagattctgtctttcaaaaagccaaagacaacttttttattcctgccaataataaatggttgctccaagtatttgcctgaaccaattgaagtggaaacacttattgcagacaaagagaatctcttatttttgtatgttgatcagttgatcgatgctttaccatagatgtcaaggattttggtgtgagttgtcgattctttctcagttgccctgcaaaatagaaaacaatcgtcagaaaataaaaggtgtgagaggattggtgtccttctacacatcttaataccatgaatatcctatctgctctcagatttttaaaaaaagtgagacaagtccttctgcaaagaatgtcgggtgacagaggatcaccctatctaaagcc

SEQ ID NO: 6365 - DNA, 1300 bp, Glycine max
  Soy_ogl_4090 Gm12:35247201..35248500 Cluster 28
ttttttctattaatttgtataatacaatatgcaaaaatcaattgctatgaattaataaattttgtaggtgttgattagaacatattgctgaaggctttgattctggatacgcattaagcatgcatccttcgattagagatttcatcgccaagttgattgtcagagatcgaatctcttttttactctaaccaaacaatatatgatgttctattcttatattctttttttactttagtctaattcattattttcttcatatgttatttttaaagcaaatataatgaaaataagtgatatcaatcggtagacaacttacttttctgaaaatttagttgcatgtttgaaatatatgtcatgagtggtagacaaggaaatcttttttctcctcttctcttttttgattataatagaaagtcttagaggaatcatgagatccgcagcaggaaaaaacttctttaggggatacgagcatattgaaatttcttatatatttggaaaatgaaatgtgtgcttcatatttttgagcttgtctcggggcaaaagataatcttgtacgagaatagttaatttgtttggtgttagtaatataaactcagaagaggaggcagaaaatacctttttttttaattgcaacattggtgatctaccaaatatctcggaatttcagtgggagttaatcctagaagagtaagcacttgtaaacctttgttacataaggagagaacaaattattttctagacaacaagcacatttctttcagagaatgtattactatcctcaattttgtcatctcttgtcttctgatgtactttctgtttttctacaaagctccaatccaaggatggtaattcattttcttacaacgattcaaaaataattcctgaggcaatttggtgatggaaggggtaaattgggaaagggtatgtaagtaaaaattgatgatgtctaagaatcaaagacttagtactcttcaattggggaaaaaggctattggttgaaaggaaattttaagggatgggattttattagcctagtatggaaaatggaggccataattaaggagaggaacatctgattcttcaaaaagtagtcaacatggaaagacgtagtcaaaaactaaaagtacaaatttgaggaataaattaaaattggcttagaaaatttatcgctaggacaataaggaaatgataattttaaaaattttaaaaactaaaacgtaaaactcatataattaagctaaccactcaacacatagatccagtggatgggggtggcattattttaactttaatcagtaat

SEQ ID NO: 6366 - DNA, 1349 bp, Glycine max
  Soy_ogl_4318 Gm13:28047088..28048436 Cluster 28
tgaaaatcaaacaattctcaaagtcaaaaacataattcgcgtgtttttttaaaaaaaaattaagaataaaattcattgatataaaagtataacaaccttgattacctttaaccaaatatatagaaactatacacatatttccaataagtaaactaacatccaaacacaaacttcactaaccacaaccaaaccacagaattacaatttacaccactctgatgtttttttttctcggttatttagtttatgcttttatttattctttatatatgtcccattataatgtaagaagaaaaaataagtattaaagtaagccttgttttagtttttttaatataataataaccactttttcctactaatactcgtaataagtagtattattttaacttttcaatgtaatattagtctaaattagtcacgtacaaaacttttcaagctcattaacagcaccccggatacacaaggctaaaattgattatcatgttgcaactttgatcatcagaatctgaacagattgaacttccaaaattgctctaagagtctcatttcttgttgaagaagctagatagttgactacaaaaatgtaatcaaaccactaaattaatgaaggcaaacataataaaaaagaaattcatgtcacaaagttttaggctaaaaccttcacatggaacaatcaatgctatcttctagatctgtttttgaaacttctcaagcaaacatattaaacttagttggaactcatcaaataccacaagctggataaattcagcttcatccctacccattgcaaactagagagttaaaaattttgactaacccaaattgtttgtatgggcttcctgggctgattgttttgttgggcctacagtttgcaattttgcaccctgtattagtttgttggtgttgaaatttaggatggagatgaaaaaattaactagttggatataattttaaggactgataaaattagaatactgatataattttattgttgtaaaatatagattttgtggctaatatcagagccttagagctgtacttccacactttacaaatgatataccaatttttctttataaaccttttcacctttttatttttcagatgtttcacaatatatagtttttttcacctttttctttaagaataattgaattttttattttttttttgcaaataacagtaatgaaacaatagttttaagaaggatatataaaactgatcaacaatcttacaagtcttatcaattatctggtgggcgacaaaggaaaaccaaaaaaagaaaaaacaaggaacaaaatcagttctttagaaaacacacccctggtgctttggtgcatccgcat

SEQ ID NO: 6367 - DNA, 1400 bp, Glycine max
  Soy_ogl_5149 Gm15:48156301..48157700 Cluster 28
caagaaaatccctcccttagacccccgagttcttaccttcatggttcagttagttaaattaatttttattttatttttgttgtggttttgatgtttccgtactttcttttccaaagtatacagcttcattaatttagttgttcttgtaattgatttttcatgtcacttagaaattgagtgcaatcatcaacaatcagaagttgattacattatatatttatataataagtggctttgaaaattataggttatatgtaaacaatagtatgcaagaaattaacaatgatggtagcagggtcttgaaatgcaaagctacgattgtaataattcttaagtatcctctggcccaaaattattagtattaacgtaaaagctaacttcattgactccccaaatttttagcaaaccataacgtctgcttcaatctgtggtcattatatatgaacatatacttcttgccttcctggcacagtctacgtgcatgggttgacaaaacaatgggaagatgaaacttgaatgaaaataacaccaaatttgataatacaacaacacataaaatggaaagttaaatgtacagttgttccattagtggttgaaactaaaagctcatagtcataaaaaaaaaaacaaacttaaaccacttaaagtttatgataatataaagtggaaaaacatatagctttaagactaagctttcttcccctttcccattttgttccccctttccattattgcaacttcttcctcatggaaaaaacgaacatttcattgcaccaagctacttacaattgcattgaaatctaattctatgggaacaatatactaatttcttctatttttaatgtacatactaagagtacgtttcagaatacttgaactctctcatccactagaaagttccaccactgaaatcaacatataaataatttgggttttttcttacatgtggaaactttaggagtggactcttattgtgatcataattgttcgatatgatgtcctgcatcttcttatgttatgtctcccacctttccacctgcttgatttctggttcctgttgtttctctttatttagaatatctctgatggtgcactttctttgatttttaacttactttttggcgtgtcttattatatatcacattagacttaagaacctcaacaacatttagtcaaatggagaaaccactctaaaacttaaaaatgtatttcacatattactctacatttttatatcgtgttaggaaatattattttaatgttaattaaaactgattgttctataagaactatttttacaccattgctttcaaagttcagaagaaagaaaaaccttccaactcatcctacttaactggtgctctcaaatatataagaattaccagttctcatctatataa

SEQ ID NO: 6368 - DNA, 1400 bp, Glycine max
  Soy_ogl_5760 Gm17:38434901..38436300 Cluster 28
acctaatccataacagtaacctcgtgattggaggaagttaagtcaatcatttttcggtaaatatatataatatgtatcatgagttctaatagtatcctaagatgatagggtgtttcacgcctggccggcatgatgtacaaattttgaggtcattgccatatatatggaaccccaataaaccatatcttatagaaactatatagctagatatatatatcgtaccacttcacttctaaatgatgatacgaggtgggataccacaaagggcatgaaagaaaactttcctcaatagggaagtgccatatgaaaataaggtttaatttacttgatcacttgccctttttgctggacagggaggatcataccgttacttacgtgggttgttgattccgagtgcttgatatatatgaagagacatgaaaagacagggcgagagaaattaaacaaatatttttgtggatatagtatatataaaataaacaatggccactttgcatatcatatatatcatcaacagcaccaattacgataagcatcttccttctaccacgggcaaattaaagtcctctcaatatattactttttgggtaaggggtggtgtagtaagctaaagaaaataaagagctcaatctttttggactagagagagcacgttgatccttacgtgcgtgccccggccagttccactttcggcaaacctaaacggtgcattcatattgctaaaaaccaacaagtaaattaaatgattattttttttctccaatgcatggaagtttttgagatttatttacacaaattaacaacttggcaattgacacgtacatgtataattttgaaattctttctctcgtgttttcttcttggtatgtatgaatacctccagaatcacctaatctaacaaatgaaataatctcaaaaaatataatagtcaaactaaaatggtggttcaagaagtaacgagttttgtttttaataaaaataaatttttacattcgaatcttgtaattagatctattgacctaattctcggattaatccaagtttaagacttacatgtgaatcaactattacaagattatttaagcttcatcaatgattttgagatttattcttaactatataattatgttaagtactcaaaagacacacatatatattatctaactctagtaagattgtttcatgtaaaagagacatgtgtgattttataccaaaaaaaatatcaagagatattataagattggctttatgatttatgattaaatgaaaggagatattgtgaattcgaattatctcttattaataaattaataatttagtaaaagaaaaaagaaaagtaggcaaagtttaaaataatttttgaatataaaaaaaattatatatgaataaaagagttgtgg

SEQ ID NO: 6369 - DNA, 1500 bp, Glycine max
  Soy_ogl_6648 Gm20:158701..160200 Cluster 28
cttgaatgattttgcatttacttaactttttgcttaattatttggattttacatcttcttaattactgttattaagttttgtatgggatttgttggtcctatatttagatgcatttgcttccatgcatattcagttcctgtagacggtctttaaagcaatgcttccatattcggttcctatacatgatttttatcaatctatcgaactttattgagttgagtacttttccttacaaaactcttcaatataatatcatttgtttatcaaagaaatgagattattgttttatgttcagtacgtgttgttcaagttttctattacttcaaataaattctgtaagtataaaaagaaaaaatcattattttcaacatattcaacaagttcaaggtggaagatatttgtaatttcattcttgtaattttacattttggtcctattgtctattttctcatcatgtgtttgacctttagttcacatccccacctttcttgtttttgttgtaggttctcttcagctactacttccttaaattcattcaatcattcattcaagagcagtataagaagtcagttaacctcttgctcaaactctccaatgtgtggagacctaaaaatgaaaaagtggatcaacttagatggtagaaaatcttcactaatgtaattgaagcaattcaaagttgcaaatctctttgttaatgtttattcaatagatacagtgatagaatcataatatatttatgttttgaaaatatgggacacactgcctccagagaatatctcaaacttcgtgaaaggtcttggtagtatatttgggaggtagactgatgaatttataagtttctgcaatgagaaattgctcaagattttagcattgaggctaactagctagaagattttcttattgtttccctgtaatttaattgtaagactcttagcacacttttccttttaaaaaaacatgcaattaaatagactatgacgtgaatacacataaacagagagacaattgaatatattagcaaaataacagttacctatgccaaagagtaactaccaggtgcgtgtatggttttaaagggctctccctattaaaggacgtgtgcatatgtaagaaaataacactcacatttatgtactttcggttttatgtatcacctaaagccttttggattgcaccttaaatctgccagagttgcaaaatcacaaaaaataaaattaaagaaaaagttatttccttacaatcaatagcaaccatcactatcattaaatcatccaaactcattagaaagttaaatttataagataaaactggcaaggcaccacagactgctccaagcctagtttctctctgaaataaggatgataatgcccttgccaaaatgcagaacttactaaaagccctgataatttgtaccttatagagatgtttcttccctgctttaccactatgtggggaagtgaagtattctcctcactcaagctttcctataatgtcaaata

SEQ ID NO: 6370 - DNA, 1200 bp, Glycine max
  Soy_ogl_4218 Gm13:23347601..23348800 Cluster 28
ctacaaaagtaaaagttacatgtctcaatgtatatttttcattttaaaaccatttaaataatcgatcaggagtttctaaaaggtgaaaaggaaaacgtagtgaataagttatttttttgtcggtaaaagttaacaaaaactgtaattatatgacaaaagctcaacttttagcaatgattgtatttgaccaccctcaaagctcaacttttagcaaacagttgaagaagtattaattaacaaggcgggtctcgttagaccaactcaaattttgttcccttctagtcaattaaagtagctcttaggattgaaataagttattatggtgttctaattattattttcagttgaaagtaagcaaaagataaataaataattaaaggacaaccagagcctggataacgttcctatctaaactaaaggaactttattaaatgaaacacgcactataataatgtgaaaagaacactagtgtgtcttatttaatcctttaaattacccattgttaagaaaaagtaaggttttcttctaaagaaattgaaaatatggatggggcctggaggtttgaaaatcaactgcgggaggcagctgatagcctgatatgaagtgagggcaattaatgagcataaagtcatttaggtatttaataaaaatataatactcccaggtcatattttagtaattaacttcatttttaaaaattttaatactattataatattaggttatcgtgtaaactttaggcatttaataaaatttctaaatccaatactgaagaaaattttagctttaaccttatatctttttgttcatatatcttccataggactagaaaaggttgtgtataaaacattttcttattccatcaattaaataaaccaacccggttctgggcatggttttcaagtggttaatctttgcgtgataatcacggacacattatattctttcctttctacgagccgtgaatttgttcacggaccggtcaagattttccagatttcatgcacaacatacatacaaattagcgatcatcaatcttttgtttttttttttttgttttgctacaatgacgtcaaagtttaaatttataagcttgtacaaatcactcaagcccctcttatcatgaaccgacttttagtttgggtttaatctaaatctttctataatgttacaagtacaatctcatgacacatatgcagc

SEQ ID NO: 6371 - DNA, 1095 bp, Glycine max
  Soy_ogl_4314 Gm13:27814942..27816036 Cluster 28
ctggtttaataatttccaattaaaaaacaaatgttttcgcttatgattaacttttcagtttttaatttatttaaactttaattaacttatcaattattttgttaaatataaattttccaatagttttgtgtcgaacatgcacatataaaagccaacaatgagtttatgtccatatcttttacttatttataaggttcattataacggaagtattaacctcacttacattattttgtgtgacatgtttctccacttgtcacactagttatttgtaaaaataattgaaaaagtgagttgcatatattttgacttcagggtaaaatgttttttttcctctgcaatttttgaaatttatttgtagttcatttaatttttttgtctatttttggtctctttaaatttgaaaggcgttatatttgatcttcaagaactatcccaattactttttgttcacatgtaaagagctatttaaacgggtttgagaataaaaaaatagttcattttaaaattaaagagatgaaaaatgggcattttttttttaagaattaaacttaaaccaaatttcggaaatttaaagaaaaaaaaatagccattatgttattggagtaaatgttttaataacattaaaaaaataccttattagagaaggaaaaggaagctcttaatatagtcatacataaactgacagtggatttgtgtccatatctgttttccctttcatcatagtatagttttttatctgtcggctataagaataataatcaattgggtaattcattttcataaattcatgattcgtcccataaataagagacaccaaatgcagataaactttctgtagccatgtgcatgattcggcaatctctagataactattagaactcatcgtcatctgctccgttctagtaatttaattctactcaaagttaattttatgagtttaaattttagaaattaaattaaatgcattttgaagatagatttaggttatatttttagtcattttaatttaataatttaatatttaattttatatgagcgatggtcaagttattaagagtaattcttaatagagttacttcttaataactcttg

SEQ ID NO: 6372 - DNA, 1300 bp, Glycine max
  Soy_ogl_3802 Gm11:8755401..8756700 Cluster 28
agtaactttaaatgtaattttgttattaataaaaaaaatgtggatgacataattttatatattctaataaaaaattaattttttaatttttttttttaggatattagttgacatttttaaaacaataataattgttattattattattataaaaattaattaaattacatagtgtcatttcataattttaacaaaaagtataacatccttattggatttttttaactatcataattaaggttttttttggaatttcgagatatttataagctttgaccctttgtccttgaatccaataataatttaaatttttattcgaaacttagccatattaattatgacatatattattaaatcactataaaaatagagtaatcgttaatgttttttaaaagaaaataaagggtgcagtttgtagtgccgcaccgcacgatctcacgcgctatcctgcatgcaaaatcagggatctgtgtggtgcgcgtgacagttccggcactggtggcgaggaaatgtccttatcatccacacgcaagagggagcgcttataaaacacagacggtctaagtggcgcgtgttaggaacgcgcacgtagtaatttacacgagacactttttgaagttgagaaattattaatgtaataaaatataggtacggatgggatctagcctcgattcgtgtggcctaccaattaaatatcgcttttcagatttgggccccgcaatcatccaaaccctgcatttccaatactaaccttctttactccacaacgcacactaacttttttttctttcggattaaacctatttctaatatctgtaaataattcgtttttagttttttttaaaataattattttttagtttctcattttattaaatgtatcatggttgaatccatttactaactccgtcaaccagactcaaccgtgatttaatttttaacgataaaaaactacaacaaaatataaattgcaaattacaaaaagtaaattacaaaataagatttttcaatcattacaacaacaaaaaaaaaatcgcaccgccgcatactttaacactctcactgccggtcaaccaaagtaatttgtggcttgtcatttctgtggtgattaaaaaatgatcacattaatttataattcacatttttgtcctcttaaaaaattcacatatttgtattaaattttaacagctaaaaattagctcaccgttaacattaattaatgaaattaataaatggttcaatggtaacgcatcttataaaataaggcactaaagttccatgattaaaaataaaattatta

SEQ ID NO: 6373 - DNA, 1489 bp, Glycine max
  Soy_ogl_6678 Gm20:12012..1507500 Cluster 28
tcacttcttggtcctctttgggcttgtcactcatcactttcaactgcaactgcaacaaagccctttgcctgtcttcctgcaatatattccaaagaataaatataataataaaaattatgacaagaaattaatttatcatatcagggtattccatactttggatttttgaagatgcaactcctcttccagcttctgacactcatcttcaagttcacacctcaatgctttgatctctagaccacatagtcatagagaatttcgtaccatgtcattaacaaactatccaaaaagctcaagctgctaggtaacgatacatgaatgactttatattgcatctctaacaaatactaatcagatagtaactttatttaaaaaaatggttttttcaattaattagaacattaagtaattaaaaatataactaaagacaaatcagaacacttatgatcccatgtaatagaatgcaatgatagaatatttctaagcagccaataatttcaaattcaagactttttctatgcttacgagcaacgtgtgttcatcttcaatgcgcatcaactgctgcctttgttcttctttgcattcttcaattttttggccacactttgcctcaatttctgcaatggctttgtcagcctataaaggttcaaattaattagaaacatgttgatggaaattacattctacaaataccacgaaatcatatcgaaccttttctttttccttgttcacaatttccatattctccaactcatacttcctcttaatatgattaatagcctgtttagaatcaattgccaacggcccattctctatcaaataaaaaataccaataaagaaatttcttactgatatacaattttttaatagaaatgatcaatttccttacctgtaaattctggtcttgtatatcgatcaacaggcttagttgatatcatatgagcaaatgaatttacaatcatatccagcaagcagtgtcaacacagagacattctcacgaatgtcatccataagttctgtaatttttttctattacaatagatataaatgcaatagctgaaaataacctcccctatcctgtaacaaaaataactcctcaagccatgacttgattggtcctcgtgtcttggttggaattaaatgcaattacaagtatacaacctataacttttttttaatcaattagaatattactaagcaaatatttttgccactgggatgtgatcatagagtataaagcttttctatcaaaatattcttgattcaaaagtaatgtgtacgtacaatgaatcttgattcaaaaatattcttcacaaactgcaaaactacaaacaaaatttatacacagaacacattagcacatcacgtacattgtcttttgttttttcttttatctaggaagggagggacagaggaggcaagtgattagaaggatacaaccaacaacactacctgtgcagagctgcttgccttatctttaatgctccgg

SEQ ID NO: 6374 - DNA, 1100 bp, Glycine max
  Soy_ogl_1975 Gm06:15861101..15862200 Cluster 28
ttgagcgatgtcgggtctgtataactccaacttctcaccagtgagggctgcttctcctcagattagaaccaacccagaattcgacaggtatgtatgctactgaacacttgaacttcaactagggctgacgtcaatcactctgaatttgcaacctatgtgcatgcccccaattaatcctaaacccatgggaggttggtgtgtgtctatatctaaaattagctcaaattagtataagcacatcgatcatggctagtttgtctccatgaaagtcagcaatttggaaacacaattcaacccaaacggaaatgcatgttcctggaagattttccttccttttcacgagaaaatgttgaacttttttaaggttggtttgcatgacatgttctcagtggttgaaagttgaaactatggaacactcaatgattacacaacgtggaatcaactccccaattttgtgttcgagattgaccaccacatctaaatgaccatcgttgactatacatcagatagtgcatagggcagctctctccgtatgtttattatttttcgacttttttttttgttacacgagttaattatttatacagcctagggactgggtacatctacattcaaaaataataaaatagttggatgaaaaaattaacaattaattacactagatctcctctccttaaatatattggcttaaatatatcttttcctgtaatttagcgcttttaactccttacaaaatatatttattttattttttatctttaaggaattttagataatattttaaatagaaaaaatattttgaacggtaaaaaaatattatttaaaattttttaaagacaaaaaaacataacaaacatattttacaagaactaaagctaaaaaaataaatttacaagaacaaaaataaaaaaaaacattaatttacagcaaaaaaaaatatatttaagtcaatataatatacgattattacattgccttttttctctcctgatgagttcaaataacatgtgttttatcctgtcccatcactaatataatgttacatcatttaaaataattcattcttttttacattgccattattgtccttatctttgttc

SEQ ID NO: 6375 - DNA, 1300 bp, Glycine max
  Soy_ogl_6165 Gm18:54019401..54020700 Cluster 28
ttctctactcattactttccaatttcctcactttatctttttcttcccatcaccttctcctttctattcttcacaccccaacaaaaattgatacatggcaaatgcccgtcctcttctccgcactccatcttagatctatttgtttttgccactatatcattgattgtcatcgcatcgacctttgcgaccactcgttcccttctgcaaccccatcctctacacagtcacccttcccctccaaaatttattaatcaaagaaaaagaatgattttttaatgttattcttgggatcttcatgattcttgtggaattgatctttcgacatggaaatcttccatttctctgtagagagatcttcaaagaacgatctttcacaccaagatctggggtgaagatgctgtgataaaattattcttaaaaggaaagtaattaaaacattgaggcacatgagagagagaaaaatattctttcctttcccaatgcaaatatattggaatattgatagttagtgaacaacacattatcaacaacacaaatgtgatattaaaagaagaacttgattgaagaaccaatacacataattataagagagaattccaactaaaaaatgaaaaacctattgggtattttcaattctaataatagtttagttgataaatcttaagaaaaaaaacataaagaataaaatgtcttttgtctagatgcaatttcattttggactcgaagtaaaatcttccaagcgtagagattcataaatatattcaatgaggcaagcaaagatgatagttgtcctgcttattcttggaacgtgcccttgttctatacctaaaccattatgtaggcagccaaatcccctcccccaaacaactcaatagccttccttttatttcttaaaactttagaaataggggaatatttgccagattattactgtactgtaaaagtgaaggaagatatgatacctgtcaataataggcacaccaagattattaagatgatgcctaataggttgtaaccctttatattatagcattcaacatcaaaagattaaatatttttacatccaaaatttacctaataattataattattagcattttaaaaataaacatattcactaaacccactattattttcttttaaaaaaattgaatataattttcctaattttgcagcctacaatgtcataccaaatcccacctccagaaagattctataaaaatgtgcaaggagtaaataacacaaaaacctcaatttgtgaacaaaagtgagactccatctaaaattagaataggaccgg

SEQ ID NO: 6376 - DNA, 1100 bp, Glycine max
  Soy_ogl_6469 Gm19:40191001..40192100 Cluster 28
ataatgtttgatgtgaagaacgataaaaatataaatacataaaaagaaaaggagatagaaaacatttaaacttcacaatccttgacgaaacatgactttaattttaccctttaactaaaagaaaagtttaactcattagtcatgggagtacataaacaaagaaaaagaaaagtatagaaatccctaaatcatcacaagagtctagaatgatcaaaatctgctagaatttttaaatcctctgtataagtaggatatctagagtagacctaaaacataataaaaatggtgttaaagatcttcatcctttaaaacttaacaggaatcttctctacaaagcaaaactacattattttgttctagaactaaaatatacataatgtatttaaaaggtactatatatgacgattctttggagtaaaaaattatgtatttttgtattatcaattattctcgaaaatatgatgataaattaagtcttattatgaggttccaatttaatgaattttttttgctgattaaaaaaatccttaattgaccaaaataatactcaaggtgggtttactacgccattctatatggatgaaaaaactggaccatttgaaacaacggatgaaacaactggaccattctatacaaggcaggaaagcttcttttctttttcttttcatctcataattaatatcaaacaacggatgaaatccctttgtttcattactttttttccctttttcatattaaacacgggttcaaatagcacattaaataatctttattaaaaatttgattaatcattattagtcacacttctcaattgcattttttgtaaaacttaaatttaagattttatttaaagaaattaagctcagtttcacttaaatcaatatgttaatgctaagttattttaaactaacatgatatatagtaactatgaaatggaggagtggacatgaaacgtgcaaaaataaaatttgaatgggggtggggaaggaagggttatgggggcaagtaacgtcacaaacttccttcttggatcaccgtcagttaataaataaatcaataatttttatttgatacgtatgtgttccataaacaacagtggc

SEQ ID NO: 6377 - DNA, 1500 bp, Glycine max
  Soy_ogl_2005 Gm06:17360901..17362400 Cluster 28
attaaagttcatggtgattggtcattgatctggaagttgcatactcctcctgagattaaacattttatgtggtgatcacttagaaatgctagccaactcgtgaaagactcatttcgaaaggtattacttgtcctacacaatgttggttttgctccaagtctttttcttttctttttttcttatagcatgtgagaaagaaaaagaaatttggcaggctgcaggactttgaatccttattcatttgaatatcaattctgatgaaagctaccagggaatcttatttaacttacttcacaatcttcaacctcaagagaagaataagcttgctgttattctttggagtatatgaagaaaccgcaaccagaaagtgtgggataacgttgactcaacactccagccattgttgcttctcttcctcttcaaaacagattgtaagttgatgaatactaaccaaatgtagggctcatcttttatcagttccaaactcttatatgagttttgttaggaaacaagtcaatcttgttgctcacaaactagctagggcatcaaaatttcatgttagctctcatgatttcatttgcattccaacatatgtactcagttatccttaaaagatatgattttgttttgcctaaaaaaagaaaaagatgaagctagatatgataatttaaaagacaaatcatagaaagctggaattttgttacgaccctttgataaatttccacttttttcaaattgggaaattaaagaaagagatagagagaactaaccccgtgggtatggaggagaaggtcaagcttaaaagcaagaaaagtgaaggagaaaagtaaagcatgagttagtagagcttgaatggacatggccactcttctccaactcattaccctcctctacatcttcccacaagaaagagaaaaatggacaaaacaaaagcacttgctaacacaaacaaaaacagaaactcacgtatctttttctacttctctcttttttggaaattaattttcaagatattaaaaaaaatagtttccaaaacttagttttcagaaagaggatattttagattttgttttacaaaaaaaaacacgaaaagggatgtgtaaatagtatacataggtacaaaaagcaattgtcgtaaatagataggagaatcctcatgaaagactcgtgattgttttctgattgggcttaggccttgggctaggtctatagttgggacttattatctggttttccttttgtaacagctataaattatataaataagaattaaatatgttttgtcctttaaatatagatgattattttttaatccttaaaaaaaactaattttattactacctcaaatttttgaaaagttacttttagtctctttattcattatattcatagtttcatattttgtgatggtttttaatcataaaaatgtatttattttaaaaaatgatttgtagcaattttaagctgtcaacatattttactcatatgatttggtgactg

SEQ ID NO: 6378 - DNA, 1100 bp, Glycine max
  Soy_ogl_3369 Gm10:4788501..4789600 Cluster 28
cttcttatttatatatgtatcatttatcttatttctaactaagaaaaaccatatatgttctcccgcatatatatagtcccaacttccaaatccaccttcttcaagcttgttttgagggtaaatccacgtattttttttttcatttccttggcctaaattattggattcgttatgaatatatgaatatggtgtaacatgattaatagataattttattttattctttaaatatctgttagtaaagattaatcagaaaagctatcctaagtatatgcctaaaaaaaatatttgttgttaaaaattaatcttttaaataagttttagtatctggaaagatttgttctaactttccactaaagaatattttaggttcactggaaaaaaataatggagctaaagaggaatattgaacctgatcctcgatccttggatatgcttcattgcttctcacttctccacatagcgtttcctttgccaaagcaaaaaaaagattaccaaacccacctcatgatattaatagtaactttcactgttggaattgtgacattttcccacaacagatttttaattattatcatctgtaacatcaatactgttgaattcccgtgatcttacacagttcagttctgcatagtttacttatgagggagtgaaaccaaggtaaacctcttcttgaagagggggagtactgaaagggtttgcacagattcttctgaagttccattcatgaactaaaaacttagtgtcattatggcagtattgaattctcataaccaatactgaaagaattattgatccggtgtttatctctttttttttttggtagatcccagtatttttctctctgacaagacgtaaacaataattgtaacaaaaaaaaatggttaaactattccatagatttctactatttggcaattttaattagatttttttttcccatttaaatccttaaacttgcttgttttttcaattggatcctttatctaactttgaaatactgattaaagaatctaattcaaaatactattttcaaaatttgtaaaggtgagaatattagtttcaagagatgagaatagtgtctcaaataaaaaataaat

SEQ ID NO: 6379 - DNA, 1150 bp, Glycine max
  Soy_ogl_3083 Gm09:29728201..29729350 Cluster 28
ggggcggggggttggtaatttttgcaacagaagagttgatctggttgaagagccaacataaggtttgaaaatagatttattttaaactggttaaccccaagagaacaacatctgacattgcacccatgttgggtatcaaaacgttgtcgtcttttttagatagtgcatctaggtctacgttgaagtgtgggccattgttgccttgttttccaacatgacaatgtaggttaaaatgaacatgttcgggttggtgttgcttcgctctacttgctttctcatggcattacttttgcaactcttacatttttaatagtttttataaaataatggtgcttagactcttagtcacaaaccaattcagtatggatatgaatttcttgtaatgagagactgtttcaaattgtaatgttgtggatatcttactctaaaggtgatagagattttgcatatgtatgtgtttaggtatttatttaccttggatatggattgcctttgataggtttttctccataattttgccatgcccacaagttcgtgactaaggttgtttccggttacatggcacatctttttcttctcttggctttttttatagataatttttttttattaaaatgtatttgttttatgtacgtgaagaagttgaagtttttatgctttggtatatatataaaaaaaagagttcgtgtttttaatgatgcttacacctgattatcattttgcaatgtcacattttagtttaagacttaactactattttattccctaaatgggatatatttttttagtccctaaattttggggtatgtttttttagcccataaattttaaaaaattgtttttttaatccctaacataataaattgatactttatgatgtattttaaatagtgtgacagatccttttagcactttgtgatagttttcaaatacaaattcaagtgattaaaaaataatttaatttaatacaactaaaaatcatcataaagtattaatttattatattaggacaaaaaaatatacttttcaaaatttaaggactaaaaaaagtatttttaaattttaggaactaaaaaaatacatatcccaaatttagagactaaaacagtaattaagcaaggatcacatcatcacttgaaaaacttagacc

SEQ ID NO: 6380 - DNA, 1111 bp, Glycine max
  Soy_ogl_6663 Gm20:1030975..1032085 Cluster 28
aacttagaaagtgcagaaagcaacaagattagtttgcttatattttaggcaaaggtttttggtcttcaaaaggaagcaaactgacccggcaaatctgagcgtacttaatttcaggtgtgggactgtggggttatatatcatttatttgagatgataaatttataagacaaacgaaaaaaataaaaaagagataaagacgtaatattaaaaattaaaagtcttttcgcacgcgttttacttttttttttcagtgaatctttaactagggacagatccacatcagttgttcaaagattataacaattacaatatctgattgtctagaaacaagctgatttttgaatattatcaattttctgtaatagatattattagcaagattacgtttcttatatataaacaagcgcacatgttgcatttgttttaacatcttgatataggtcttcttgtattagggagacttttgattttttctatctgcgggatatgtcccgtttattgtagtatcattttgagtttaatataatttacattttttcaaaaaaaaaattaaaagtcaacaatatttatctttatcttactatcccgaagattttttttataaaaaaatggaataataattactacgtttcatttatgacgtagctctgtccacaaactgtttggacctcggttcgattacacatttcttgcacttctaatctcatactttttttaaggaatttaatctttaacatttcatgctaaagattgctccccatcccccacacccaacaaaaattctctgtaaaaaaaataaaacaaatttttatctttatatttatcttttataggtgactttaattaaatgcaataagacatgcatgatatgagctaatcactcgttagtaaaacaaatgtttctattcaacttagttatattatgattttttataacaacagcggcaatgaaatctgaatgaggatttcatgcaatttacccatattctcttctactaagctgacactgacctagtgggttcctagggataaagaataaattctgggttttaaggataatcagacaaagaaaatgcacatttgcagtttaagctaatcagatgctaaactg

SEQ ID NO: 6381 - DNA, 1200 bp, Glycine max
  Soy_ogl_550 Gm02:14759001..14760200 Cluster 28
tttgggttcgtttaacttgatccactttcacactttggtttgttagactcgacccaggcccagccaagcatctcaatttgtcaactctaatgtttaatattaagcatttaaatcctgcacctcctattttaaatcttgcacctctcaaagaaagtttaatgaacaaaaacgttcccgtgtctttcttctatcttctttttctagtaacacgtgttgaccatccaccccccgccggtcgtcccgccttgcgctaccctccaccacatcacaaatctgaagcttctcgcataagctattatgaaataggaaaaataatattttaaaataattattccaaggatgtcggaacaactattttaaaatagaaaaagttctttttgaaaaaactatttcgggatgagattttttttattctaaaataattatttcagaatacatttacattttcagaataattattccatttttttttttaatttcattaatagttgttacaaaagtatatatatgttttcctaaaagtgtattaagttcaattagtcaacttttagtaaggtcccgaatgttgaaccaatcctccccaagaacctatcattgcagagttcaataggtaacctagggattctgatccacaaaccactttattgaccttctcagcatttataaggaagaagggacgccacctctgaacaatgatataatggtccgctacaatccatgcatggaccttcatagatagcatgcttgtagtcctcctccgtagaaactgcacaaggtaacatgtctatgattttgatagacccattcgagtcctgtgtcttaaagtgaacccaagtacccaagactttcaccacaatgtcttaagccatggttgggaccatgcttgccactcttcatcagagagaccaactattatcatccttagcctccttacccagctcgtctgacacaaccccatccttctctatggaaccctcatggttaagtagcttatccttataaggtgtctgaggtgccatcttctagctcattcattttaacttttttcgtgcttctcacaaaaggatcctttttcctggcttgacggcgacgccatttcctcctcagactcgccgctagcgctcatattctacagcaaatgttttgttattgtccactaaataaatgcaacattaaatacgaaaaaattaccttaactga

SEQ ID NO: 6382 - DNA, 1400 bp, Glycine max
  Soy_ogl_2552 Gm08:7981301..7982700 Cluster 28
tataagtataacttataaatagttaagcagtagtaccccactcccaattcaccatgcggtagacgtaaaaataaaggatgcatatgaaaatgtggaagcaaagaaatgagtcagaattgataaaaaaatcattgacttgagttattccagtgcttcatttccactgtctgaggacaaagcaattgtatactacaaaagtataagattgttataatgaagacacaagttgtgcaaaagttatagtgtataggcacaagttgtacagtgcaaatgttgagtcggttcagaagaaccaaacaaattacgcacaatacttgacgtctgagtaagttattgaatttgtactgtgactttgatcagagtcttgtagcaacaccaacaaaagccttatgctactctgggatcaagaagaaacatgtgccttgtacaattatttattggacaacttttcctcatgggttgtgggataaccatgcatgtttcttatagcacatatcaatggtttgcttaaaggatctgtaattggattcaggtttgacatgacattaatgaaatcaggaatttaatttagtcactaattcaaggcgattccttggctgtcattgaattgcgcaatactactctctctactccttaaaaggagctttaataataccatctcaaaattagaatacaaagactaaaaagtataagcacacgaggtaaagataatacttgaacctgctaaaaagttttcgttcgtaccagagagaatgtacaattaagtagcggcttttttgtgtacaaacgtggtaaaatgagaaaatacttctaatactatcggatagagaattaattaatgatattttgggactgacaacataaacccacttaaaagattatgtacaggatcgaataacaaataatttcacccataatgacttatttacgagggatatatgaattagctagcaactaaataccctgactaattggtttccacttaaagtatgcaagccattgggtatgatgttggatccagatcctaacactaggatttccatatctaacactaaagaatattgttggtttaggaaatgaccaaaaatataaaaacagaagatctataatggaaaataacattatctcttttataggtaccgttcttatcaaaatgatttgtggtggttttgtagtagaagcaaacaaattaagagtcaattgtgcctataagtataaacgtctttgatattatgtctgattgatgaagttttgatttttctttattttttatgacaattttcaaaaaaggaagcaagatttagttaaaggttgcctacaaatgtcatcatctccgagttgaaagacattactaagcaaccaagaatgaaaataaaaaaaaataaattattggtttgtcg

SEQ ID NO: 6383 - DNA, 1421 bp, Glycine max
  Soy_ogl_528 Gm02:13624401..13625821 Cluster 28
tttttttcttaatttgtgtattataatcttaatgtcgaataaaagaaatggatggaataatggagaaaggtgatcattatggaaaatcgttgagcataattgcacattaaagttgatattgaatttttttttttttaaaaaaaaaaactatatccattcaaaaaactcttcctatatccgtatttattttcctgaaaggaaactattttaacgtaatttataacgggctcctaaaatgtcaagcaagcccctatagctcagtggtagagcgtcagtcttgtaaactgaaggtctgtagttcgatcctgcatgggggcaatcatactttttcaaatattgaatagctttcctcctattaagtgattaagtccattaccaaccaatgaaaaaaacatgccaggaaataaaagaagttggtgcttttttcttttttattttttatgagaagactcctcctcgtttaaggactaatttatcgcatatttgtaatttgtgtactaaattaacaattaaatagactatttatacgcatcttttagttgtttttgctgcattttaacatgaaaaaacagtaagacatggatcgcaaatgctatttcaaacacacactaactcagtaattatcccttattatagattatttataaataaatgaaataaaaaagctattcgaaagtcataatcccataccttccaattagtcaaacttcgtattagctcattttgctgggtaggggcaaacttttacacgatacatattaaataacataaatatttaaattagtcattgaagataaactggacatcatcacgtataagcaaggttacatatactcacattcctctaagcattcaagtgtaaattgcacagtggttctaacatgcatttggtgtctttgcacgaaagacattgatttttttggtagcctataattagacattgatttcttaaatacatgtgagaatgctacagaaaaaaaaaaaaaggaaactaggagactgaaactgaaaaattaaaaaataatgtcgtgaggaaacctttagtgtcgtggcagaagatcttgcctttggtttttgaatgttgtctctctctcgacctacgtctgtgtgatttgttatactttgatcatggaaatgactgtaaagcaaaaagcaataggcaaaaagcaaaagaacaaaaacattatttagaaaagaaaaaaaaatactatattgagtgtaagtggcgtgtaagttacaataacgtacgacaaatcatgcattatttgtccatgggccatcggtattaccttattattcattcaaaagatacagttgagtagtcattctaattgaaattatatatttttaaaattttgttgcaatgtttcttataaaaaaatataaaatcgataggtaacatatcagacttcgatattttc

SEQ ID NO: 6384 - DNA, 1563 bp, Glycine max
  Soy_ogl_2754 Gm08:18184438..18186000 Cluster 28
gaataattattttttccattttttaagcaattattttctccatttttttctgaagtcacaattatttctccttaaaaatagtttttcatgcacatttcaggctgcctaattcaaagtggtatgatccgaatgaattatattagttcatccataaggaaacattcattagtgggatgttgcaagtagtataaattctatgatacagaggatgaaaaaggctttgatggttgtcaacttggcattattcagcaaattagagaaaaccaaattcactcaaacagtttgggggaaaatgtcattaccaatccaccccatcccatttgttacagtttctaaattgtgggttagcttaacattggtatccaaattgtacatatagaacaatgtataaaggagatatttcttttttgtgtatacatcttttttgatgtttttgtctctaaattaattagaaatcgcaacaacacatgtgtaagttggttggtttctgacttatgaaagtaattcagtttgttttaaacataatctcgaatgtcactgctaatttacgggaggaggttattttcacattctgcctatcttgtagactgtaacatctcttcaatcttctttcttaatcatccttcttatgctttggtcagtcttctcattattcaatccccttttcttctttttttatgtttttattcttaattttaatgtcacatatgtgttattcacatgcacactatcaattaattagtgacctttctttcaattgatggcaatgttacattcttaattgcaacttcaattccttgcttagataatttgttttaaagtaactatttgcttcaaaaatggaattttaggttggaattttttattacttttgggatgtatttgctgaaaatttgttccggcgagattggctcagaaggacatagtcctgtgaatttcgccgaaggtttgttacatcgtactaattttttcttttgaaagtttctatttaaggtttaagatttgtgtgactaaatgagttttttctaggtaattgtagttgctctgctgcttcaagattccattcaggtgtgtagtcgaaaggtggaatatctctacaccctggtcttgcgtgctttggagttcctttctcataaaaggtttgatttttgggataaagtttcagcctatattcacattttgttatgtaaaatgcatttgtacaagcattgtcgtccatggaggggagttcgataattaaaatgtgcgattgggagcgtgtgggagaaaggggcttcttgtattatttttttaattcttttttggtaatttgtagtagtttttaatccccataaattatattttaaaatttaaatttacaaaaaaatgtcatggaggttccaatagatttgaattcattcaaacataatttcaggccaaaaaatcacatattttaattttccatggatgagaaaatggataattttttttacaaagaacaaaaataaaatttactaatttttttaaaaatatatatatattttaatcttttttttttcatcacttcaaaatttaaaaatgact

SEQ ID NO: 6385 - DNA, 1167 bp, Glycine max
  Soy_ogl_4184 Gm13:21340901..21342067 Cluster 28
tcacgtgagcatatttaattaatgcaagaaataagaactgtaaatttaaattatataattatacatagttaaattttttagaaatacacatgagtttaaatatttttttagaagcacgatttgtataaataataatatgaaatttgcatagttgcatagtacgtctagatttataaatgttatttctcacaataatcaatgaataataaccaaatggaacattatacatatacgacttgtgaagaacatatcaaccaagaataattctcgttttaaaaatgtgaaaaactttaagtatagatcgtataattatacataaataatcaaaattaaaatttatttgatgattgcaaaatcaattaaaaagttatgttcattttttttaatcttaatcatttaaacacaatctaattatctatatttataatttttatttcaataagaaatgtttcaaattttgtcttcctcttccccaccaaaaatatcgtcacctgtaagtttctgacgttatagatttgagaaatattcaaataaaaataactaaagtcaagtgtatgcataacttaagagttgtgtagaattaggaagcgttatgataaatccattcaatggagatttgattgtgagcacagaagcacatcctcaccccaagaaagaataaaattaaaacgaaagggaaaagatcccaaatgtgtcaatctcaaaagcaataaagccaaaagcgagttcgtgctttagagaagaagttgctgctaaaacaaaacgcgtttacagcttgctctggtgccgttttgctttaggatctccgtatattaatattctacagcatttctcctattaaataatgctaaaggaaaaaaagataaaaacgcggaatttgagctattcgtggatctggcacgtgttgtggctaaggctggttccatggtcaagaatctctcaaaaatcgaaactaatgggggcaatttgacttggcctttggattgcattgtcaatatgctatctgtaatctgtgactgcaattttaaagaaatcaacttttggggggtatcgtggcccttcgcacacatttttagcgatcccagtttttgggatatattccaatttcaatcaaatgatagtgcagtcaaaaactctccataatttgtttagaacgtaataatagtg

SEQ ID NO: 6386 - DNA, 1000 bp, Glycine max
  Soy_ogl_1982 Gm06:16127201..16128200 Cluster 28
tagttttttctgctgaaccttcgatcaccatttgtcaccttcagaggtgatttctagcggtggcgtttcaagttttatttttattttttttttcctcgctaccatcattctcttcttcctcttctttggcgctgaccatcctgtggagttggttcaacctgataaagttattgaaactcaaatctagcaaccccaaactcaaaagactcaatgatacagggagcggaccaacaaattcaaggccctctatgcaaccaccacgatgacatcacgcactagatctacactttatactgttcattttcaagcgtaacatatgaccaagacctatgagtcattgctatcaacgtctcgtttgttcaactctttgagcaagttccgtcagagattgaagaattggacaaattgaaaaaattcaccatcactgtaaatcttggtttcaagagctcgtagctcataatggccattggagagacatgccgctaaacaggaaaagccgctcttgtggcggtcacgtaggctacacacttcggctctttgacaataccaacgactcacacaagatggagaacaaaagtgatagaaagagcagcccattgatgcctttcgacaacataaatgggacaatgtgcatgagagatctatgtcaaacatgggttagtttgtggaagttcacgattatgggtggccaaaactagtggagggttgatgaagggtggccacaggcgatggagtgccacaaggaggaacaataaaggggcaaagatctgatggaaaaggtgtataatacatcgtgtccttgattaatttgatggttgttaatagtagtatatgatggaccaccgtgaaggtggtagaagtctcctattaccaaaacattctttagagtgtagacaacttacattgtggaccactactccctatcactctctctcactctttcactataaactcactcataaaaaactttaatacaagctttccatcttctaaatgatga

SEQ ID NO: 6387 - DNA, 1289 bp, Glycine max
  Soy_ogl_6657 Gm20:576401..577689 Cluster 28
tagcatacccaatactcttttgctacattcactcggttgtttatctgtattcttttccaaacacacgtatctggacatgcacctgctccatgtaatgcggctacagttccaaaagttcctccttttcattgttgcatttcccaaacctttcctctcaagcatgttgcaaaatggactatcaatcaataatatcaatgtttgcacaacctttagttaacggtgaaatatttatataaattggattgaggtatgttaaagttgacattacttttcttacatgtaatttttaaaagtcgtattattttagtgaataaatgtggtagaacatgaaagcatcttctaataaatggaatgtttggactgtcattagagcctcaccaagaaaattactgtactggtttgtgtaaggaaatctctttgagaaaagttttctatcgtgttgcattgcaactttggttttttctttacatcttcgcctaccatatctatacacacacacgagtttatacgttccaattaaccaatgcatatttgattcaaactctcttctatcacattccccttcctcttaaacacctgtcacaattcttgtctaaactgaccctggaagtttgtaaaatacaaagagctaagaaactgttccaattgagacttaattattttatgactttgatcagtattttcttccttcttcgatggccttaattatatttgcattgtccactagctagttctctatatatcctcactcaacccatcatttgctctctccatcttcttggtctcaccacagtccatacatgctctctctatctctcctctttaattatctctttctgagtgtaattgggtttttagtgtccatgcatgaatcatttttaaatctgtaaatatatagaaatggtttgtgatatataacctaaaatcattcatatatatatatattccctagtagcttataaatttctagaattgttggctattggagctccattcttactgtccctatttttccaataaaaagctaaatctcagcatatataagtcgagaagcaatctaaatttgataaaaggaattgaacctttgcataagaagtgcaaaacgccagcacagaaagttagatccataacctccaataccgcaaataaaaagtcctctccaaacctcgcgaaatgcttatttgaaaagtacgtagcatcaaatagcagtgatcataaaccaacgttacacaagacaaaagaaagaataggactcaagtataaaatttaaatgaatatataagattgac

SEQ ID NO: 6388 - DNA, 1000 bp, Glycine max
  Soy_ogl_3880 Gm11:18516801..18517800 Cluster 28
tatctttttcaattttttgtgttagaaaagttaccacaaatttattgtaatctatctttagtaataaaagaacaacctacaagcacagtgtcaccctctcgaatttttcacaattttttattcctcttgttcttcgtggttccactgtttcgcgctaatcgttcaacttgaattttgaaatcgataggccagcctccttcgacgctagattgcagacatgggaggtcacatcgccgagtctcagcttcatctactctcgcttgcacgtgtcagcgcttcccccacctcccgcgcaacctttctgcgttctgcttccatgcttctttgttccaccatttttcgattttcattttcaaattcaaattcaaaagcgtagcttaggtgtgtgtaggttccacgcacaactcattctgtcacgccgccgagctattcgcacaccaggctataccaacattgtgcaatagcttctgatttcacacaaatgtgagtaacttccgattgattttcatttgttgtgtttccaaaaaaaatccacccagcctagcttccgattgcttttcttccaacctcatttctgcattccagtttcacaatctaaccacgatcctgcattttcattctccgatgtacagaggttgtcacctgtgttggttgaaaaagctcaccactttgtaaggttctttgtatattctcctccccctaagcgccaaaagttttttttcttttccctttttcatttctgtgcagaaatccgatttcttgctcaattcacgtcgctgatttactttgatttttttcctcaggtcgacagtggtaccaccatgtcggagaaaccaatgccggtggcggaaaattccaaggaattgggcacgctggagcctcccaatgtatcgttcaatactcttctcgaagaattgagcatgtttttaattttatcttggtagaagaggtttttgccataaaagtgtgtaaaaaaaagaattgaaaattttatctaatt

SEQ ID NO: 6389 - DNA, 1200 bp, Glycine max
  Soy_ogl_2606 Gm08:11323201..11324400 Cluster 28
cagcgattgtggtgccttcaccggcagttatggggtggctaatggctattgtagttgaacaacgtatggcacaagtgcaacaggctactattatgaacgagctggggtgcaacgcaagataaacaaagtccattcagggtcattattattttcattgcggtgcagcacacaaaaaatggggtgaataaagcaattgtcttcaaactattgcattttgggaaccgaataattggtgtaaaggcctggctatttcaatatgcaattaataaaaaagagtatgtttttaataattttttcgtacttaaattgtgaattgcgattggaaaatataagggttgcaaaaggttattggtgaataaggatgccaaagaattcatatcctctgcagttgcctttcaaactgcatggatctttacccattaagtttattttatgcaaaaaattataaataatgatgtattactaatgaaggccattagatcttaattgtatcgggtgcaattcatttttgaactgtaatcaaaatacgccagttctgatgggctaacctagccagtccaatttcaaacatgagttgggataataaaatttaggcttgaaatcattttgacctaaattagcttggccaaaaatttattagctcgatacaggacaactcaaggtgggtgagactaaaatattaattttttattttttttaagaaaagagtataatataatacacacattacatctctacctttcctagtatttttctttttttttttcttctataagcacttccttttttttagctatcatcagaagtgttttaatttttgaaagaatgagaaattgagataaaaatattctataatgagtttataaggttctttttattactatcttaagttcatcttttagaacaacatgtcgttggtctaaattaaactgtgatttatctcttcccttaaatatattttgtattccatgattatgaataaaaaaaatataattaaaaaagaaaagttcacttaatatttatcacacagagaaaataaaaggacgttgtagtatgattttttttatataaaaatcacatattcttcgcataagataattttgttcaaataaaataaaattattattatgaaaaatataattcttcctataaatatttaatatagttatatattaatgtaagactactgtaatagtattt

SEQ ID NO: 6390 - DNA, 1522 bp, Glycine max
  Soy_ogl_2702 Gm08:15313779..15315300 Cluster 28
ccttaacaagttatataagcacgtccctaaaaaatctagtttcaaggtctatccgttaatgtaagataaaaatgacaaaagtgatgtcaaataaatactttttgatgttaatgctattttgcttgcttgttatctagaggacgggctgatgcggatccatcttcgctgcacggtgttgttcgacttctgatagaggactatccctatgctgctgatggattagagatatggtctgctatccactcatgggtggaagaatatgtcagtttctactacaagtcagatgttgctattgcacaagacactgaactccaagccttctggaaagaagttagagaggttggtcatgctgaccagaaaattaatgcaaggtggccaaagatgcaaacttgttccactctcatatggactgcttcagaccttcatgcagctgttaattttgggtaatatctgtatggaggctatatccttaaccgaccaaccctcaaaaggtgtttttgaaaacaattacagggaagagtgatgcccttaaaaaccttacaattatagaggtcttgtcaaggcatgcttctgatgagttgtaccttggacagagagatagtgaattttggacttgtgatgcacaaccattagaggcattcaagaggtttggaaaaaagttggcagaaattgagcaaaagctcatccaaaggaacaatgatgagacactgaagatgtcctacacattgctctatccttctagtgaggaaggtttgacttgcagaggcattcctaacagtatctccatttaattaaggtttgacttgcagaagccattcctaactagttagttgcgacaactaactagttagcaattacctttaaaataacaactctattttgaaaatttaaaaatgtaatataaataaataaaagtcatctgaaacattcgttaaatcagactctaagcaacttactgatggcttgctttcttgtcaatggtccactcagaatttggatctattgatctgcagaattgtaaagaagctctcaaccatatccctaactctttctttgagtttttcttctagacaagttaatcgggtcgctcactcctttccaagaatgtccagattttttattactccacaatgtctccagcatatacattcccgattgtatcatactcttattattatgaatgaatgaaataatatgagcttctttcttgaaaaaaattaattaatcattataataggaattagatatgcacgtcaataatctatgaaaaaattgataggttaaaataaaaattttgtccttttatttatatttttggtttcatcttttgataatttattacactaactaggttaatttgataaaatatatggcaaactgtgagagttgctacatcattgttgtatattttccccctgtttatccaaaaaaaaaaactagctaaaattgctgtatattttttagtgttttaaataagaaaatatttatttttagtttttaaaaacatatacttttatttatt

SEQ ID NO: 6391 - DNA, 1071 bp, Glycine max
  Soy_ogl_2952 Gm09:2673901..2674971 Cluster 28
gaagaatattaaacaccacaagcttctgcagaaacactaaaaaacgttgttagtaacttgagatagcttggttgggcaagagtgaatcaacgttaaaaataaattaaaaattattgtgattaaaaagtgggttttttaggaatctaatcattagggatgagattaacattagtgctctttgactagaaacgaaacaagggaaggaaaaaaccatagttaagatttcaaattacacctaaaacgcggatcaggcttaatgtgttaagatgtgaaactgaatcattgattacgccataaaacacactaatcaagcagagggattcattctcaatagtcacatggtttgaaatatgtacccaaaacctactccttcttgtttaattttttttttttttttttgagttatcaagatgttagtatgatgaatttatctataaaaattgaatttagtttcatttgaatcaatgatttattaatattcaaattttatttattagtggtgatttatttaaattgcatataatacgcacagtgattacttaaattatgaagcaatataaatcctgaaattatcacttaaaaattatctaatcattattttctatctaaaattgcacaaacaattaaatcgtagcaaattgatcatatacctaaaaacaaaaagtgacaacaatgggccagcagcatggtcccagtcccagcccaggcctatgtggagtccgtttgttgcacacaagttggcaaccaacagtgggccacaggagtttgctttagttgtgggcttgaaagactcattcaactcctgatcgcaggttaggacttctgtcccacgttataattatttttattattactagaagaaaacaagcaccgtgtcttttaatatttttttataaaaaaaaaagaaaagaaaaacgataatgaagattaaatagtagtggcctgtgactagggggtagtttgcatagtacaattgaaagttgtgactggtttggagagtataatgtgattaatagagaaagtagagcaaaaagagaacaaaaatcaaattaaaataaagtaatgaaagag

SEQ ID NO: 6392 - DNA, 1400 bp, Glycine max
  Soy_ogl_4610 Gm14:2545701..2547100 Cluster 28
ggtagtttggacccaattagtacccattagaagtgtcaaagaacatcctcacaacatcatcttgttttatgtgacataatgtacattagaaagtgacaactaatcctaattattgatccaagactaattggtagtcgtttgtattgattagtaatcgccgttgtcctttaacggacctataacctacacctatgaatatgaaagctagcttcacagtcaagtatcttcatcttcatcctaaaataccattattgtgataacttctctggtaaattgaaaattagtatttttgtaagtgctacaacttagttcacccgttcttagccagccacgactagagtaatagttcattggagatttttttttacattcaagtgtgggccttgcattttaatccatggatcatgaatctgtgttcattccactacagtttgtcttctcagttctcaccatcgaaattggagagacaacaatttgacccaaaaaaaaggggtggagagacttttatctacttttttgtatttaatactattaatgtttccattatcaaatgaacaaaattggttaatttccccccctatatgattggttgttgtaacttataaaaacttcagccaattacagtagataaaaagataatctatatttttaaaatctttaattcctataattcaaaacgatgggttttaaaatataagagttaagactttacattgacaaaacactatataattttacatgaattcaattacaaacatgcacaaaaaaataaaataaatgcttatttttatttttcaacaagaatgagtatacgagtatatgaactgatgcgttaagtctcgagacctgatccgtttaaccctttggattttacatgcttaacttgcgggttcacggactaacccatgcaacgtagtgttgttccctacaatccttatcttatacgatatggagggcatgtcaacgtcgggtattggattaagtctaactctataaagtattgtttaaatacattgacaaaggtcctgatcgagctatcttatagatagataataacacgaatcattgtgttgatgaaataattaaaaaggtattatgattgtaggtacctatcatcgtgcaaagcagattgaagaattttgcatttgatatacatcatagatggccgcgtgttcaaagattgatgtttccccttcctaatcaatgagaaggaagaaattcaaacgcttctcaaaaggaatgaggaaggactcacaatgtttcttgcttggttacgtttgaagcaaataagcattttactgaaggcagatattcatgttttttcttcttgcatctatatttaacattgtcattttttacaggtctacaaatccaagataatgttttgagaaatctctctc

SEQ ID NO: 6393 - DNA, 1091 bp, Glycine max
  Soy_ogl_570 Gm02:15626546..15627636 Cluster 28
tcactataaactatagtattactgcattgacattttgaagaaaagtcatttcatgtctgcgttgcactgaatctcatgcctctctaaacattagacaaattccttctgcatatatgctttgattgtttcctaccttgtacgctttgtattgaaaatgcttgctattaagtgaacgtcaatgttgcgtggatcttaataatccgtagttgattgctctgaggagcagcttctgtcgattgcagtttgacccagtgcatagtgtggaaatgactcagcttgaataacatacctttataaaattaaccagaaatagcctcgacgttagaatagacaagtgtctccaatgatatatcatgctggcgtttcagcatttaattaaagttctttagtagtcttaatataaatacaagcattcaattaaaagtattcaaccactcattagtttaaggatttacataatgataactataaataataaatagttagattataagtagatattataattataactataactagttatattgttttatataattaattataatttgatataatcagttattatgtttaaaatatatgtatataactgattataaataaattagtaatataactaattatataataaattatatttaaaatcaattacatagtctattgattatgaatgaataaaaataagttatttgaaataatcatttctataaaactagttataattttataactataattattttttaaataaaaatatattatttaaaataataatgcttataaatctaattatagttttataactagttttataaaactagttataattataattatttttttaaaattaattttcttagcagtcctaagcagaagttatcgagcccatactactatcgttataattatttttgtggtgcaagcaccttgatagaagaggggaaataattaatggttaagtggaggaacctccttcgtcgtctacatgattcccatgtcttaaaggtcttggaatgacgctaattgagaaacatcatggctaatctattatattgttttacttaggaccacattattaattccattat

SEQ ID NO: 6394 - DNA, 1400 bp, Glycine max
  Soy_ogl_4188 Gm13:21652101..21653500 Cluster 28
tattatctttcgaggtgcaataagaaacatataatagtgcaatacacaccacgccatcatgagaggcaatatttgttttcttttcaggctagaggactctagtgggtattaggggtgagttaaagacgtgatgctagggctaccatggatcacgtgtataactgtatagcatggttgattcaactataaaacaggacaataactaggttagtaggataaaaaagatgcgtggtagggggtagaaaatggttaatacagacacacttgtagtgtttatttatttagttcactttatcatttgttaataataatgttattatgtttgactcgtaataagtgtcatgttaaacaaatcctaagataaaatgttattttaatttttttaatgtattattaatatttatatccaaaaccgagaccacaacataaattccgcatctgcaataaaactaggctctgtccaagctggctatctttcaagaaatgcaaaggattcagtgcccttgcatagccaaatgaaaaacaacaaaaaaacccgatggctgatatattattataaagtatgtaaatgttaaagtagtgcattatatagaattaattaaagactaaaactaaaacgtttatctacagttacaaaaataaaacattttttcatagtaagatggcgcatgtgcatttggtgctgtcttcctacctggtcacatacaattgaggattatataataaagttattagggtaaaatatgtttttaccttgtaaaatattatgaaatactccgagggttcgtttgttacaaagtattgttagtatttgatattgggaaaggtctactttccgaaaaatgaagaaatttcactcggacacaaggaaatatccgagagggtccattaaatgattataattaagaaggcatctaaacaaattctcagaaaccactgaagagtgagaagacagaacagtaccacagtatctcataattatttccgatactacgaccctgcgactggtggatttgacattaacttttgacgatgcaaaactaatttaatgctgaatctgtaatccaagaagtaattttactttccaaaaacattgtcaataacgaattatgtgttagaaagtgtatttctaactttcctcctgacaataaaaataccgtagtttccttaaaagatgatttaaatgtaagggaaatgtcgttgaactatggagttccctctaaaagaaaccctctcatcaatttcacatgtattaaaaaaacgattagaatgcaatgagaatgtaaatatattttacattaatcataaaatgtcatatataataaatttctatttttataataattattttaaaattttgaggttgaccgacaattaaacaaatataaggttttaataat

SEQ ID NO: 6395 - DNA, 1870 bp, Glycine max
  Soy_ogl_5998 Gm18:8695560..8697429 Cluster 28
gataatacaagacagagagaagggtagtggcagtcacaacatatatatagagaaggcatgaacatatcagtccaatgaaagaaaggtcatgtagacaggcatagcataagttacagatataccagtaatgcatacaacaacaatttcaaattagttttcgaatcaaacatataaataccttagttcgaggcttcaaagatataatcaaagcacttccacagcaacgccaattagcagtagtaaatgataaccctaaaaaaaccatacagaaattagtcatagtgtatttaaagccttttatcaacaatatgagggttgtctagtattcgaatagagaagaaccataatgataatgggtttagctttttccgtgagtaatggagaaggaaaacttgtctacaatagtactagtagttgtttcatttgcacactgcacaattcacatgactttcagcacaagctaactattcaagccatgatgaccataggaagaaccacttaagaaaaattcttcgaaaacaaacaaacaaaccccatgaaaggaaaacaaacaaataaaccctaacaacacaaatcagttaagagtgctggtagtagctttacatggatcaggcccaatggtagtgtgaagagtaggcttgctagattcctagtttcaaaccagtggctgtctacttggcctgatagctgtcaacatgtcctaccacacaacgtttctgatcattgcccaaccatcttgcaaactaagctggtggattggggtcctaagccatttagggtagctgattggtggattcatcaaaaagggtatcaaaaattggtgagggagacttggagtagtgctcagcaggggggttggggggcaagctgatgtacttaaaagatgtcataaggcaatggagtaaagattatggattcattaatgacaaaggaattcagaaaatccaacagaagctaaatgaagtggaagatctagcatccaatacaagtctatctgaggaagacatcaaggctaagagagatttacagcaacaattgtgggagatctcaaatgactatgaatcccttttaagacagaaatctagagcaaagtggttaaaagaaggagactgcaactcagcatattatgtttgaaatgcttccaggtttttgcaactcagcaaagtggctggttgtccaaatggcctgacagctcccaatttaaccttgagaggaattactctgaccactgtcctattatcatgcactctaaatgcattgattggggccgtaaaccttttaaggtttatgatggatggctaattcacaagcaatttcagaaggtagtgatggattgttggttagattatcagcctatggggtggggtggttatgctttaaaatgcaagcttcagcatcttaaacagaggctgaaaatctgaagtaaagacaacataggagacctgtgcagcaaagtcaaacagcttcaacaaaaactaaatgacttggagaattctatgccagttcaaccttctgaacaacaagtgaaggaccttaagaaaacccaagctgacctttgggaaaaagctactatgcaggagtctattgtgaggcagaaatcaagatgcagatggatcaaagagggggacaacaacacatcctattttcgtagagttattaatttgaggaggaggagaaatgctttgagggggttgcagattggtgacacctgggtggaaaatcctaacattataaaggctgaaacccttcatcattttcagaacaggttcaatgagcctcacttgagcaaacctaacttggatggggtttcatttaaaagtctgccttctactcagagagaaattatatatgattgaaccttttaaagagg

SEQ ID NO: 6396 - DNA, 1233 bp, Glycine max
  Soy_ogl_6356 Gm19:3099768..3101000 Cluster 28
gaggagacaatgacatgttgaatttagggagtaatcagaataaataatatatgtacgttagagtttattaactttagctattgggtgtttgcatgttgtgctcttttgtttatataatgagttctctattttgctagcggtataactatagagtaaagttttgtaaatgaagaaattaatagctggaacataaaattaagatgtatcaacaaaataacaaaaactagtaacctaaaggttgatcttacaacacataatattgtattgtgtatacactaccatgatatgacgtacataggataaacatttagtatcacaaaaaaagaataaatcattcacaaccttggtcaataaaaacaatacctagccatattctaaagcatatgtcagcatcaagagctacttagctactgagacagtaagttccaatttcctagttactaataactatgacacaggtacatgttataagcagcctaatctctgcatcgtaaaaacaaagacaacaaggcaagttcagctcttcaaaatagcaatactaagaagacaaacaaaactttcaagtttcaacaccacaaagatagataacaagtaagcatcgatccactcaaaaaatttcttttcaccattatcttttatgccaaaagatacgactttcacagcagactactcacatgtctcattaatacatatatggctggaaagcaattacccctcctggaacaggaattaatataatatattttccaaaactatatagcctggaattcatattactaaaaaggaagttaactatagtttcacctaaatagcaaaggaatataggtcatcttattttttaatggtgaaggataagtaacacagttacagcttatgggtgttcaaaattcaaataatatttttttttaaaaaaaagaccacatgtccagactctataattatattctaaaaatatgaaccttgaatgggcaatgtgtctaatgtgtttctcacccctttggtgaaattatcagttattgaggttataattaatacaacaactaaaaaaaggaactagcctaacacacactatcagtgaaaataatcccaacaaggatggaatgagtcaggtgtagagggctgcagagaactcacctttcccagatttgctcacaatggatgcagcaaggacaacctgttggataaattaaaaaaagaatagagagaattaagggcagaggggaagtgaagaac

SEQ ID NO: 6397 - DNA, 1000 bp, Glycine max
  Soy_ogl_1622 Gm05:27454501..27455500 Cluster 28
gccacttatttttgcgcaagtcatccattgtgcaagtctgattttttttttttttatattttttttaatttcactacactcttactctattaaataattaacatttttctaattccactctcttcttctccctccctatttccaacctatcaaatatgctgtaatttacaaaaattctcaaccttttgaactttaagtgatgcattgaactttaatagtcttttaagtcaaaagaattcgggtagttgttacattcaacctatttgatacagatactgaacaaatatgatcagtaccctactcttttcttagtattgatacatgtgttacatttgttgctttagtttatatgataaataaattacaagaaataaagtaaaatatttgctatataaagatggaaacatgcattaaaatttacacgtattttaaattttaattttcacacttcttccaaattcaacctatatataaatacattgtgtctttcaccgatcgaataaccagccaccaaaaaatactctcactgcagaaatatctcgaatctcatagcattgaaactttacaatattttaaattttctagtgttgggtttaaacttcctggaaattttagcagctttcattccattggacatattgctactttccggtttcaaggaaattgcagaagtgactctcatttctccacgtcttgctaagggaaatgtgagtatatgatgggttagctgacttatatttgcattagtaccagtgctttctcatttggtggatacgacaagctaaagttttcttattctttatccaataattaaatcatcaacattaatgtataattgggatcgtgggtggaaatgttaggcaaggttcgaacttgtttagtttgggttagtttcaatgtggaaattctttctcttagtctccatttctaattaagtttgataagataggccacatagtgcgctgagacaagagacaaggaaagctctacgaagaaggaa

SEQ ID NO: 6398 - DNA, 1000 bp, Glycine max
  Soy_ogl_2016 Gm06:19139001..19140000 Cluster 28
caatttatgcattaaaaaagatgacagatacacacagatacattttaaaagagttaaaagtggacatctgccaacaaaatataaaaataaaaacaatctctttattgaaaaagtatttgttatatgaaaatataatatattttttttataaaattgttgttatgtatcacttgaattgaaatattgacgaaatgtcccttctccctgtaggacaacatgtctctattagagcatttattatatcttatatttctctctcttttcttttttctctcttaatattaaaatttgttgtatgagttttgttgtatagataaaattcctcacacacacacaaaaatataggtaagttacatacatttttcaatgggaaaagatggtcccgaaagggatggagtaattacagcacataaaaggcagtcaccaaatgatactagtggatttgtctttaagaattgtaacataactgggacaagaggaaagactatatttttaattattgatgcagcactgctctgttgattatgtgatgcctagggggttgaagtgaacatctatttactcagcttttgtttcttgtcaaaagaagacattattaaggaaacaaaggagggtaagaattactccaggagcaacgaaaggaaaaactgagagaaataaaatgaataaaaccataatctcaaaagcactttccaatctctctgtatacctgcaatatacccctctcgaaaaatacataggttggaatccacatagaagtcaacaaaaatattgccccggaaaaaaaatgaaattttagtttgtccagatttaaatcttataccataaaatagattcacccaagaaacaataaaatctcaaatcccaaattagcaggtaatctttaaagaacccaaatagccaagaatttgaccttaaaaccattctcttgcctaataatcatcttgtcctctcaaaccactaacaatgtttcaatccactatcttccaatccaaattca

SEQ ID NO: 6399 - DNA, 1000 bp, Glycine max
  Soy_ogl_3089 Gm09:30520201..30521200 Cluster 28
ttccacttcaaaagtaaaccgtactcacgcaaaaatcgaaaaatgataaaccaaattttctttacatttaagtgttttcctatttagattgaaggtaaataaaattttaatactaataatgagtaataaacaaaattctctgttggtacccgaaaaaggtatggtgctgtgcattcactatttccagtcaaatgatagggttacagttataaggtaaggaatcatgatataacatttatttcatttaaaagagtgacaaaatgatttatttgaaaattttaaaaaaataaataaggaatcatctgtggtaatatctcgaacgtgattatttttgcataaaattaaaacatatattattgaaacaatttttggctgtcgtcaagctgctacaaattattttggcgtttttaaatgtcggaaaatccttttaaccgctacatgtacttctaggcgttgagaacaacaaaaatgcatgtttcttgcgaaaacacaaatttaccttcgtaatatagttcaaaaaaacattattagctttttaatttgtttttaaaagagtaccattattttggtagatctttctcactgacattttttaacaaaaactaacaaaattagcattagccaataaaaaaaactattattttggtaaatctcctccatcatgcattgacaaactgcaagaacgagcaactccaaattttgtgattattttacctagcgaaatcaatggaaacaaatttagcgttgcactattacagaatcagccaacatatgctcgtgacattctatcttatctactacagcgtaatacctttcttttggttcaattctccacattttttgtctttttatttgttatttccttctttttccctttgattaagcatttatacaattcttacctttatcatttgatatactacaaacaaattgtgagatacatacagcaattgtgagaatataaggtgaggacttaggctagagaactaatacgacaaaa

SEQ ID NO: 6400 - DNA, 1200 bp, Glycine max
  Soy_ogl_3901 Gm11:35441101..35442300 Cluster 28
ataaaatgcaatttctacaacaatatgttattctccagcagaaaacaaaaaattctctgataacacatgtacaactattacaatgcaaaatgattttgtagtgaatttgttaaattcttcaccaaaatccagtgatcgaaaaaaataagttaaatatctcatcttttgtatacttaaataaaagatagttcaaaagttcatgacttctaaagaaaggttaagaagggttccaatgcacttgggtcaaacttgcgagcaaagaggtaacaaaagggatccaatattccttatagactacaaaagccacagttatattggctctcccataggttgtcggatgaggacccaacattgaccagtcaacccatgaaacatgttgaggaaggttggaatgtaatgttcatctgggtacacaagcctgttccttgctttccagattgcccatataacatgttaaaaacgtatttcaccacctccatgtcttcctgctctaaccatttctccacccaatctgcgaaactgtattcaccaactgggattcgaagtgaaaggtttgaaccaaaacaaattcgttgtgcttgcatgcaagttagcagaatgtgtttggtagtttcggcttcaactccacaaaaatggcacacactgccacacataaggaaacaacataggatctcaaaactaattgaggaagacaatgagaaaggtgaaggaaggttgatgaacaaagtgagaaaccagttgatggttgtgcaagagggaggtgcaaatttaacaaatagaatgggagtattttgggaatgtgaaagtaaaaaagtaaggtgtgatgagaataaagaggaacgcgaatagaatgaccttgacataaatcttagaaggcccaaaatgatactatctacttctctcaaaaaatgagggattgtagaagaaggcttaggttagttggagtcttggatactaatctagttagctcaaaaaataatcatctaaagtgcggagataaaaaatggaggagattattcctggataagataaaaagaagaggaggttagtttgttgattttgatgtagtacaaatataaataatcctctatgtgagttcataatgatatgctctctagactttttctgaatcatgtttgtcaaattcatctattttatgaatgtcaatggttgttgacttgttcattttaagaatgaatg

SEQ ID NO: 6401 - DNA, 1009 bp, Glycine max
  Soy_ogl_4020 Gm12:7907501..7908509 Cluster 28
aaaaatataaattcgatttctgttatctatataagacttagttgatatataatatatataagtatttattgaaccttaagatatgtgatccaaattaacaataaaacttaactcacttaaattttttattataaaaaatgttaaactttaatttaatcagagttatatggcatgactgtttatgggcaaaatccttgaaaggacagattttactgattttaattggatactgacttgagatacgaagaatttctcgtaataacccaacagttgtaacaactaacgttaatgagccaaccatagaagacaagtatccaatcgcaaatctctttctttggtcatattaattgcttccccaatagagtataactcgccaccacccgatccatatcttccacttttctctttgtctcttgtcaaatttactcataacagtagccttcccaacatcccaagttcattgctagtttcatgccagctatttttttttctttttccatttttgtccgtcaaaagaaaagtttacgtgactaaggtccttaaagttcattggtgctaaatcagacttggagactcgaagaaaaatacttacaaattattcatgaaaaacaaattctaaatcttctggatttgtgcgtgtcatccttgcacatgggccatactaatcttctctatatctttctaattttattggatgtccccaagggaccatcaaaacaagatttaaacttataatattgcgaaatatggattggatcttattaagtatatccatctttattgataacattgtcttttcttgggtcaatggaaccatatataagtgataattgcacaagattttgtaagattttgccccggacaactagctattttattcactaacgtagcaacggcaaggtagcacctaacaaccctaaattgaatgaaatttccgtatattattcgattggaaatccccgcagcacgtgtagataatattttagtttgagccactaatttttgttcg

SEQ ID NO: 6402 - DNA, 1005 bp, Glycine max
  Soy_ogl_4052 Gm12:15867696..15868700 Cluster 28
atcaaattatgaaaattcaaatgacatggtcatttgcaataacactaggcaagtattattaggatttacataaaagcatgccataaatgaaagcaggccatatgtaatgagcaattaacaaaagatcagattgttggcaaatatatttatcaattatagcagtcattattgcaatcattatcttagaccaacataaccgtcacaattgcatcgaatttctcgaccttcactttggtaatttcaatcttttgattttttttctcccttaatttcatgcctgtgttgtcttgcgttttaacgctactacgtttcaccgatttgattgctgctttcttcgagtattcttgggtgtggtaaaacgatatttgtttcttgcgttgaaccctaatgtttgctaattcgtgttattaaggaaaacagaagatggatgaaagctagagaaagaaaagattaaggaagagagagtaatgaggaagagaaagagataaacggaggaagagaagattcaggatttgtgccagattattaagcgaaattaaatggaaatttggagtccgccaataggagaataacacgtggtggtggcaattagaaaggcaccagaaggtgacacttgatgttgtaagtttcttactttctttcttttctcatcctgcaagttcctaaggagtacatgtttggtaaggcttctttggcttaatcctttttttttaaaaaaatattctatttttttttgtaacatttggttgttttttttttcctgctaacatttgaaagacttgaaatttggtagaacttctttagattaagtatttttttggtatttttttgttgccgctttcttgagatttttggctttttgtgaatgcatggttgggttttttgtatctttttttttgaatcagtttctggtggggtttgtttgggagaaagtgtggttaagtaattttttttcatattaatatacatctctatgttgttttcttgcatagtgagttccttcac

SEQ ID NO: 6403 - DNA, 1046 bp, Glycine max
  Soy_ogl_4071 Gm12:33537055..33538100 Cluster 28
gattcaagcatacataaaataatatatatatatagaggatgaatttggttgagaaaaaatatgatgaaaagaaagataaaatcttaaaaatatttctttgttttatttttcattgtaccgaatcaatgcttaatgaccacgttatcccttctacaacagaaaccctcgtttatgtgatttcatgattgtcttcctcttcaccgtcagtctagcacctctgccatttacaactttgtactcctcctccacataaaagacgtgcaacaactctagtactcaactgcaaaacaatcaattggtttctcaacctgtctccgtattctttaaaaacaacccattctactagatttggtaatacatgatattaatttcttcaatctctaatgatagctgccttaatattgccattgcccattgggttatcaacttttgtttcaatgcatgacagttatacacggatgtataaagtataaattaaacaatttaattctggtggctaataactgcatgttttatatccaccaaaacacaaaatgctgctaatcaataaaacataattggtgagaactgagaaggacaggatagaaactataattataacccattttgtttttcttaataataaaataaaccttatttttatttaattatattctacgttgacctttaaatatcaaaacgaaacttaagagaggaatgaaatgtgacagctcaagacgggagtttcacgtgggcggcattgcgtaggtgatatagcattaaagagaaagtgtacggacgggcccaaaaccacgtgaagggggcgtggagttggaaggaagagtgtgaagaagcagtttccacggtttccccttcggctttggcatctccctttggtcggacaaattatcaccattcactgcctttcaaacccacacaaatcacaactttttcctctcttttttccttttaagttgactgatgatgtgataacttttttcatttacatgaagtagtttgttcgtgtgatgttaaattcaattattttaagtaaaatcttgaattta

SEQ ID NO: 6404 - DNA, 1400 bp, Glycine max
  Soy_ogl_4208 Gm13:22738801..22740200 Cluster 28
ccttggaatagtgtttgcacaaagacaattgtaccctaccctacactacataatagtaacattgtattaaaagtttgaatcaattttgaagaaagtttgttcaagttctgttaagaaaataagtgtcaaagtagaaaatttaatgtgaaaaccagtattatgaagcagtttaggattgtgacttcacatgtactccttttccccaattctaattctaataaaattcctaaaaaattcaattgttaacacctcttaaatttgcaattaataattgattcaattaaaaatgatgttttccctaatttaatccgaattaattcaaggcaaataataaactcagagagagattgattaaaatagattaatccactagaaattcatacaataaatttgatcatgtaaattaaatgaatccaaatttattcatacaataagtttaatcatgtaaattatattaattggtgttttctaggaaggtaacactcacttgatggttgacagggacaacaaatccacaaacctattaaagtggaactaactttttttcctttattatttaaatatctaacttttaataaatattaatttttttaaaacatatatactatttttatacataaaattggaattaatttttaatttaaatgataataactttaaccattatcataaaaacaacaaatacataattagttttacacaattttattttagttatcaacttaatcattatagtaataataacaaatataattaattttacataattttatactaactaactgtaattattataattataacatatataattaatttttcacaattttactttaataaacttaaaaaaaaaaaattatgtacatgagaaaagcatcaagaaatggtgaggctcagaccccttcattcgtccctaaaataagaaccgtcactttggaggacagtgccggtagaagaatcaagctaatgctttggtctcagttttgccacgtggaagcagtggcggagccggagggaatggggtggtctacggtggccatgaccacaccaaggtttttagaatctttatatattatgtgtataatataattatctcttggccccctccctttgctatatgagttttctttactctgtcattttttcatcctatacatgttttactttttaggtttctttttgtgggtttttccattaaatagagttttctctttttttgcgggggaggggattttcacatgagagttttctttactttattcaaggcttttgcatccagtattttctattttattctattgtctagttattaattcattagcatttgtatcctgtatgtttttatttcttcttcttctttatcttgttttgtaacttttgcatcctgcatttctttattg

SEQ ID NO: 6405 - DNA, 1050 bp, Glycine max
  Soy_ogl_5097 Gm15:39687251..39688300 Cluster 28
ataaaatttacaaaacagagcaatatagtctagcggagttcataaacatcggtttgttatgcattgtctgggtactacaacgccagctggatgagtaggcatctctatctggcatgtgctatacagagagtaagataaatggacaaggccattattgaacctgaccttaaatgttccccttgcattgtaaattaccctattattctccacttgcctttgaagtttgaaaccaacattcatgttgtaagtatataaagcttgatatcaaaggtcacttattgcagcctcttttaccttggcctttgagtcaaaggctgcattgtttgtcaagacacaagtctgtatgagtacaaaagatcaatgtgaaaagactcaaacctcaccccaaatctcctgctaggattggaataatttgcaaggagagtgaattgaccatggggtttggcaatttcatggaaaggtagataatcagtgttgcaattccacggaatataagcattaggctggaatatgtattgaagggtggaaagttcataaagtttgaaaaacttattaaggtgtgacataggttttgaagactgaaaattaagttgaatcactttgccatataaacatttaagaggtgtcacaaacagatttagttcctttcctattttcttgttgattacttttgtatttctatgtttttggtacaaattgaaattctattataatatgccatttttctgctagcttacttttaggggttgaagggatagactttggtttgtattgacagtttgttagttgccaaactcggactgaaaaggcaataagaggtacatacttcttttccccattatttcagccttttatacatgaatggtataaattattttttaaaatgtatttgttatgtgtatgtgtatgcgctactatgaagtagttattcctagggatatcattttccttcgttggtatgtgttcgtgacatcatgcatcttggttaaaatgagcattataacattacatacgagtgttcaaatatgtaatacaaataatttttttaat

SEQ ID NO: 6406 - DNA, 1300 bp, Glycine max
  Soy_ogl_6051 Gm18:16305101..16306400 Cluster 28
ccaaacacttcagtatggactagttaaattggacctaaacaaagtcttcaatgaagcgttaagaggaactctaggggacacctgacataatacagtcttttcaagtgcttcaatgcttctatggcttcttggtgttgcaacatacgttaacctgttatatttatagtgattttctcttgttgcaaccaagccaatgttgtttgatttcagcaaagagataccatggcaaggcagaggactctggctgaaactgaacctagacttgcctagagtctagataaaaaattaaaaagtgtgaccaacagagaatctgttcagagaagtatcacagtttgcctttttctcagtgtgtctatttgacacatactcaacttgcacccaaatataccatgcaatgtactctaatatacctttcttttaattttagtcttttttaaaaattgtttttttttttaaatacttataacattcaacttttttgtgtgttaatatctgctattacttaattaccgagatgactaaaaagttagaaattcaaataaaaaatatatattataaaaactgaaacaaaaacgatatttgattttttttgtgaaataacgttactttattaattaccaaatgatgtcgtcgctttgttaccaaatggtgtcgtttttttttaaactttttttgggaaatgttagcatgtctctacacatttaacatattcataaaatacataaaaattaaaaattaaaaaatataatgataaagtacatgaaaaaaatcgcatgataaaatttgcgaaatcattattgacaattcaacttcttttagtttttttttttatcatagggccaccatataaatcattataattgaagactgatacaaaacaagtattcgggccacagtattattccccccgccttttcttttataaggcgcacatcctataattttttctctttattcatcaaattctgctgaaagttgaattgtcaatgctcaagagtcaagattctagcaattttttgcatcaagtaattaaggaaatttgtatgaagacgggaagccacgtctaagaggaaatgggctagctagctttacctgatggatttgattccagcatgaaacagttggaatatggttcatttggaaaagtttgacatggatgggtcatcagaaatgctcacgatgaggcattttcaatgtcattcttcatgccgttctttcccccaatcctgaccagattcaacctggaaagcttgtatgttcaaatgcacttctcaaaaggcttttcaatggtccaaattct

SEQ ID NO: 6407 - DNA, 1094 bp, Glycine max
  Soy_ogl_6389 Gm19:33629907..33631000 Cluster 28
accatcatttaattttgtacaaattaattctttataagttgtactttattatagagttgtgtgaggatgaaagaaaaatgacaacaatttttgaaaaaaaaattaaatagaaaatgcattttaacgataccttgtattcatgagcactttaattatatgtacatgctttaataaaactttgtgcgtgtgcatgtgtgcacgtgtgtgtgttttttcttcttttcccaaaggaaaaacaaagcattgacatattttatcaacatagaaataaaaactaaatttaatgatgtgtattttgtaaaatatattatttaaatggttttaaagcaatatttcagaaaaataatttgagatgttacaaaataagtgtcatgcacatagtcttggatgagcattacgaaacacccttcttattgaattttttaacatctccatcaattatcacaaacactggagactttcctttcatggtttccaaaaattattctaataaccgaacatatgtttcctctattttgttggcaacaacaagaacaccaaaaacagttctatgattatggtggttgacaccgaataatatgaccaacagatcatacttattcttcccgtaagtggcatcaaatgccaagacatcaccaaatacactatagtcaacttgaataatccaatcacaccaaaacaagtgttggagtctattctcttcatcaaccgtgtgttagaaaaacatcaacgggtccttcgcttctaaaccactgaggaattgcaatgcagatttagcatcatcgttcctcaactttcattgccttccagcttggttatagacatctttcttacgataagtaagcttgtcataacctccacactgatatgtagttgctccatagatttgtggcgtacttatgccaacaactctcattattcacttgcattaaatcaaagtcactcattgtcctatgacttggcaacatcctgcattcttcatcgttcagcaactcatgactgtgaccattatgaatatatgatacataccgaagccttgagttaatgccgatatgcaccctacactctgttctacacccacaccttgtttttcg

SEQ ID NO: 6408 - DNA, 1300 bp, Glycine max
  Soy_ogl_6409 Gm19:37130701..37132000 Cluster 28
ctgaaggacaagtagttaagaaagttgttcattatctgcaaacatccttccctcctcaagtgcaagcttctagcgtacccgctattggtgctcagaaaatcccaaaaacaaatccctcttattactagctattttgaattctttagttcctgaatgtacaactttcaaattgttgttcgttcccctctttgttttatgcaaaaaatgaaatcaatatcaaacaaaacatgcatacaattgtcatcgttattgctacttgaaccataaggaataccatctaaagaagtacttcaaaacgtttatttattttttttggtattttttgaattacaatttgacttcaatatctaattttttaatgtacttaggtggaggatgttgacgaagagaacgagaaggaagaaagtaatttaaagaagattaaggaagtgtcacatgaatgctcgttggtgaacaagcataaggccatttggatgacagagccttaggagatcacaaaggaggagtattatgctttctacaagattgactccaatgactggaagagcatttgcctgtgaagcacttctcaggtgagggacacttatgcctgtaagcctatcctctttgttcgtaagagggcaccttttgacaagttgacacaaggaagaagcctaacaatattaagcttggtgtgatttaaacaaggaaataacttaagacttgcaattgtaacttacctcttcatctcttttatgttaaagttgttgacattgtgcatggcacaataaacaaggaaataattgctgcctgctcgtacaaagatgctgcttccaaggattctgcagacgattttgtgatgtccccaccacaaactggtagacatgaatttttagcatgctaaaaattgtcctaccccaccccagcaactgcaagatttaagttctattggaacagtaaatacagggctgaaaactgtaaataagactgataaacttctgcaccctatgaagattttagtttctaacattctgttcaatactaaatttcatataccagaagttaggtttgactaatctttctggattctatatggtgaggatgaccaagtaactgttaaatcaatcagcaagcaactccatgatgtggtgtggactcgagcttagataagacactagagttgtatacatgaatatgttgtatgtttctattgcaggtagagacacctgaaaatttgaagtttgtgttctcaaacaatatcaatgacctttgaaatattgtatagaaagtagaaataataaaacaaggatttgtttctttg

SEQ ID NO: 6409 - DNA, 1100 bp, Glycine max
  Soy_ogl_3395 Gm10:6575001..6576100 Cluster 28
caatgagcgtggaaattacactgtcgtcatttgatttgtctctgagaaaccttaaaaataaaacatgtccttggcttcattacctcgtggttttcctgcgaatagagtaatatagaaataggggctattctcgaatccgatgttcatgcatgcgcttcgcggaggtttcttaatggatcctaattacgcgacaagatccatgacaatgatcaacacaacatgatattattgttttttattcatgatgaaaaatttgtctcagactcagtaactcctatatagtgtgttacaagagatttttcaaattatattgcagtgtaaattactattgtctcatctacttccgaaattaataaataataattgtggatgaaataaaagttataaggttgatttggtaattttaaaaaaattaccaaatctaacaactatagaataaaaatagctgtggacgaatttccttcgacgatttgaattgcacaatatataactagtcctatataatatatcctgtttctttctttctttctttaagtttttgcggcagttacgaataacttttaaaaagtgtgaaacagtaactgtttatttgcttttgtttcattttcagtccaatagaacttcttcttcggtaaacttagtagtcaacggaactattaagtgtttaagccctcgccgacatgcctagaggctagaggtaatgacttaatgtcactttccttaaacttgtaagattctatcaaagtcaaaaaatagacactagctagctatgttaaaagtattgttagcaataactatcaaccttttatattccttttaaaaaaagaaatcaaccttttatagcttattttatttaataaaattactaatgggagttcatgatgtacaacagtacaagtatctatgcccaaactaaaccccaagcccaaaaggacccaagttagtccattacagtttgggcagaggacagatctaaggcccaaaatattagcaaatagcatgctatacgcgtgagcgtatatttttcagccttgcttctcgcttctatgaatttacccctcctttgtgacaagctaaattgaatctttaggtagaagaag

SEQ ID NO: 6410 - DNA, 1200 bp, Glycine max
  Soy_ogl_3426 Gm10:36673001..36674200 Cluster 28
tactgtacataatattttcttttaattacaacatgtgtaatttgattttaatttctccaatgttagaggtttttaattaagatctctatttgttgagagagagaaaagtattctctctctgttttatttttatttctttacttttaaaagaaaaaaaatattttttttatttatccatttattttctctccgtctctgttcgtcattttatccatggataagtaacaatgcatgtgaaaccaaaaaaatttttctttttcaaaaattgtttttagaaactttttctttttttaaaaaaaaatacttgcatgttaacacaggacctaagaaaacaatttggagttcagttacttcatccgtttctctaacaatatagaaaaattagacgaacatgacattaattaaggaaaagcccagcatgttgctcagtccctacgccttctttacaagacaaaacttcacgttcgggtgtgtgttgtttgatattaagttatctcactttctagtagtacaactcaacgtgaaagagataaaatgttaaacgtaacgtaactgagtttcaagaaacaaacaaaccaaaagtatgcaaaatagacctaaaagttgcaagttggacgaattatggtttcattaatttcgttaataacatcgaaatggaggaaccgaaaataaagcgaaacaaatgggaccagaatttaaagcttaattggttgtgggagctaagtcaaaagtggttcactcttgtatcttctaatttagacacgaagattctatcaaaacaaacaaaaattgacacgtagatagaaaaaaacaaagaaggccgcaagaaataaaatgcttttatctagaagacaatctttgttctttgataagtgagacatatagatcatttatatttcttttttttttttaagagaaaaagttggcatatactattccaaagggaaattttaaatgttccgtagatcagagtttactaaactgacaacttgaggtggcaccagctaaaaaaattagtccatttatctttaagtatggtaagtactaattaatgatcttcatctcttcttcttttaattaaattaattaattgtatctttctataaatatttgtaattctcacatctaagattataaaaatataatgtaaatttaaaacactcatattatatataggacatgttcgcacaagactctcat

SEQ ID NO: 6411 - DNA, 1252 bp, Glycine max
  Soy_ogl_460 Gm02:9843901..9845152 Cluster 28
agttttaggttcacgcaaatttttttgctaaactatatttttaatttctcattaactaatctaatgtcttcaattgatctaaacggacacaaaattaaaaacataatttgctaaaaaaaattacatgtaactaccctagtgagtctcttgggtgatggaaaaagtcatcggtcgacattagtattaaatcataagttaaggttgttactcactaataaagacaaaatatattaacaaaagaagaaaaaaaaataacaaaactggtaaatttttttgaaggactaatagtaaaatttgagaaagtttaaatgccaaaaaacaaaattaaccccccaattttattatcgattataatacaattcatacatttttctctctacccatttattctatttttgtgtgaatattcatcactcttaaacaagggcaatattttgttcatttgaggtgcattatcgagagagagatcccaactcctgaaaattaaagcatccaaatttgagaagaagatcctccttcttccaccgcctacctagccattttcgctaacactcttgctgtgtttctcattccttttgcttcttcctttgccaataccattttcacagccttctatacgacatcccactttatacaaccctccacctcaaagtaagtccattttttaacaccaacaggtacaccaattttaattacctcaatcaccaacttttcattgtaaaattgctttgcagccacaggccaagtgatcattggcaccccaacagttattgcttccaacgttgaatcctatccacaatgtgtcactgatgcccacaattacttcatgttcaagaatcaacacttgaggtgcccatcctcttatgattagtcccttcctgtaaggaatgaaaatgatgacatggacaataagacaaaaggaagcaacgactcacatgaggacaacaggcaaaataaccaactagtcaaatatttgatgaagaatacaaaaatccagggcttcaggaaaggaagcaagcccaaacgcttaaaggattatgtgtgaaaagaatctataaagagagagggaggtagaacgtgaagtggagaattttgtgggtggattttattctcttctatctcattccaattctgattgtatcttctccgtctattcttttgtttgtttatcatttgattgatatattgtactattccttcgagtacttgtcttgaaagttgatcattgtctctgaaatcaaataaacagtat

SEQ ID NO: 6412 - DNA, 1470 bp, Glycine max
  Soy_ogl_1687 Gm05:35475313..35476782 Cluster 28
ctttataatttcacatattgtatgcttattagttatgaagctcaagtaagcataacatcttaacaaattccattccagaccatcttaaatcgaacaggttgacattttgagcctaatcctcctttgtgtctcttcttgacttttgttcttgccggagtgagttacaaatatttttattaataattacataaacgaattgctcattgtcttgagagtatcattccctcatctcagaataagggaataccaaacataataagaggagtgagaatttcattcatttttatccattactattcccatcaagcaaagcaattccaatgaaccaaaagttagctaattggttcgtacagaaattcacagaatgccatttccacactagtgttgtcatcacaagagttgctatggttgtaaatgttatccaataacctgcattatgtgttcaccttgattcattactcaatagatctaagttcttgtgactactcctgcagttgaacaaattttgacaagttgctagaaattttgagtttatatattaagaaatcctgcttaaatttcttcgatgaaatgttgtgttctttttgggaatttagaatataagaaggattttttgctttgtatttgtccaaattctgggataatttgctgcgagttattgtcgttagactctttattgtgtctctgctgactatgctttatgcccttttgacaggaatttgcctgctaattatctccatgaagtgatgtattgagagactttgggtggtaagacacacgagatcctcaattgcagtctcctgtttctcagtcagttccttatctgatgatgaaagctttttcttttctttttttcagaataagatgacaccgaggactttagtagtgttcaggctgcctccattgtataaaagcatcttttacacttagattcttgtggctgattgattgatctcttcacattttatacccttgtaaagagtgatttgtgagtggtaataactgcccttgaaagggagtgttgtgatataagttacttcaaaactgaactttgtatagtatatagttgaccttcaatcatcacatatttctgaacattttataccttcaatcatcacatatttctgaaaaattgaccttttttcatacttttttctttcctttaacatgaggtcgttgggaggctcatttgctagaagctaaagaatcaatggtagcagtaccagaatgcaaaactaggatgtgcagtattcctctctcaagtgtttttggtccgaagaaagttgactattattctcaagattttgaatggaaggaaaaatgagagggcaaaattttcttccctttcatttttgtctcctctccaatattagtatcaggataatctggaggattttgacaaaattattctcaagattttagtaaaaaattattctcttacttacctatacttaaagggaaatcctaatg

SEQ ID NO: 6413 - DNA, 1400 bp, Glycine max
  Soy_ogl_2394 Gm07:36397001..36398400 Cluster 28
gttcagtcttttcgcggcgtgagagaggagaaaacggctagaatgatggaaaacatttggcagtgttgttgtgattccttgcatgtgaatttgtctgacttgtgtgctgcacttgccaatgatgtagcatgtagagcggctctgggaaggagatactgtgggggagaagggagggagttcaacattggttgttggagttcagggagttgttggttgctgtctctgtaggggaggactatgtactttggcttgactggatgagcaaggttaatggtttgtctcagagagcacacggagtggccaaaaatttggaccagtttatagatgaagtgatttcggatcacgttaggaatggaagagatgggcatgttgatgttgatagtgaagagcagaatgattttgtgaacgttttgctttccatcgaaaagagtaagactactggctccacaattgatagaactccaataaagctttgatattgataagtaagaacatcatttgttttgtattttgcttcggatctgaggttttgtacatgtaatattgcttcttgatttctgtctttgctctggatgattctgcttcttataataaatcaataagtagagagagctcagattaacagggtcacgtgtttcttaaaatttgaattgattagatctcaaatatctagagtattttttttcttagttcatctgtactggcttttattattggacagtggtgctgtatgacctttggttgtactagagtttcctatgatgatttgttattaaatgaaattgtaggcacaaggataggtttgaaaactgtgaaaatgaatataaggatcaactgcaagaattggctgtctagttatgcagcaagaaaggagaggaaatgaaagctagctgatattgtactttaaaaaaaaatcatcttttgatttcttgtttatgaaaatgtgtcatgagtgattcttattttcataaaagagggaccaaaaagaggtgattttttgtgaaagataaaaatcactcatgacatattccatcaaggagagattaaaaggtggtgattttttatagactcaaagtgaaaaattttatatttacaaattacaaggactaaacatgtttaatcttttatttctatagtattcgaggacctgcctatgtatattattttcgtgagtaaataggtaatgtgaattgttcaatgtttatgaagagttgtatataactacatttaatatattgttgaaactgaaacatttatcattaaatcagcgtggtttggtaactacaataaggtgtcatgtaattttgttttcttttgttcaggacatgcttgttgcaggtactgacacaacttacacaaccctggagtggacaatatccgaactgttaaagcaccccaaa

SEQ ID NO: 6414 - DNA, 1200 bp, Glycine max
  Soy_ogl_2597 Gm08:10646201..10647400 Cluster 28
aacaaactcgaccctttagaaagaaagtttagaaagttatggtaaatattatttaagaatcaattttgaatgagtatcgttttttttacatattataacaagaaaatattcccacttacaaattcacacgaaaacaatattcttagtgttttatgaaatgttcaagtctaaccgattttacctattttgaaattagagtatatgctctcttggtcaacatcataccatttcgatacatatttcagttttaatttggtttataattattttcttctgctactacgataaacactgaattgctaaaaaaggttacaacttttcctattttttcttttaaaatggaaaaacgtaaactatacatgtcaacctgaatcatattcggaccacactaatgagtaatgatgttaatgaattgtcaagttcgtagttgtagatcttctaaattgttttttttttttataaaaaaaaaaaaagaaatctttctaacttgtcaagaatggaatcaatgattgtcataatccatctccattaagtgctaatactggcattttaaaaaatatttatccaggtctataccaattatcataagctccattttgttggaaatttatgaattttcaaggaagttggagtaaaatggctcataatgaaatgggataaaaactcaacaaatgaaataaaattgaaggggtcactctatcatttagttgttcatgtagtttggtgaagaaggggcaatggaattgaagccatttctttctaaacatacttacaagttgtaaccagtcaatttttccttgacagttcctcctttggcatgcttccaaacatgggaggagtcgttcacagggggcatgggccgggattaggggatgtttctattttggtttcatgtatagacccaataaataaatgggaagtagttgcctaggaagggaaagagttaacaggtagtggtagagtctctcgcacacaagacaaagtcatctctacctaaactaatccaaaataaacaaacgttggatgtgcattatttttatatttccttgacattgtgctagctcaattatgaggcatgtggggtttagataatattgtctaatcatttgaataaattgttctttatcaattcataacacccattaaacaatagcaatgcaagttttagaaaattataacttaaaattattttaaaaatgg

SEQ ID NO: 6415 - DNA, 1200 bp, Glycine max
  Soy_ogl_3519 Gm10:43675501..415700 Cluster 28
atcacattttgtcccagaccttgtttaggtacggctctagcacacatggaccccaccagcacatgaggcacccaaacacaccatttgaaaactgtaacaacagaaaatatcttaataaatcataaaaagtggaagaaagaaaatgaatgacaaataacaagagatagatagctacatggtactttgcattgacgagaaaaagtcagcaagcacacgtggcagcacccgatttgcaacagtggcgcgaggtgacgagtgagaagcaatggcaaaaaatggggatggcaaggtcacgtgagggaagtccccacgtcgcgtgctgttgctgaactagctggaattcagtgggtggggtccacgttaactggggtagtccatattcgccacgttgagaaacgtgtggaccgaaccatctaacatgcaacgcgggacccacgctaacatgccaaggttaattaaggtaaaacaaagaatggtacataggttacgcttcttttgttgcttgttcattcgctagctttgtccttcagctcccgcacatttctccttttttttttttttacttagagtttaatcttttctttttctagaacaatggcatcctagactttagtatggatgtactttttttgtaaaaaaatcataattcattaatttattttttacttgatttttaagatagatattttataatgtgtattaaagaaattttataatacaatcaaacaacaattattatgaatacaaaatttatcgactttttatataattagacgaaattacatgtgcaccttaaaggttgcttgatacttttatgttatgtaatcatacaaaaagtctccatttttttctggatggttaacatcaagcaacattcttcttggcatcttatgttttttgttatcacaaataatacatgatattcttatatttttttctgttttagttctatcaaacaataatattaattgatgatataataatgatataatcaacgcgtgatgtgaaatttgattggacaatttcatcttatttacatcattgataattttttgaaaataatattgttaatttttaagataatgagaaatgatataacatattttataatttaattagagaaataagattgtgatcgtgtacatgtaaccttgaagaatccaggttgatgattgatgtcaataaacttttttaggatga

SEQ ID NO: 6416 - DNA, 1400 bp, Glycine max
  Soy_ogl_3864 Gm11:17286701..17288100 Cluster 28
cgtgacaaagagaacacaacgacagagattccttgcatgcacctaagagagagacaaaagggtgtcactatcctaatcctcaattcctcatccacgtccaatccaacaacatgcagtggggcccgcacgttacgtatgccatcaatgggaacgaggaagatatgatattatgtttgtttatatacttcgttaatcactaatatagtaatatttgttaaaaaatctaacttggttaaatcctaaaaatttaaaaataaaagagattaattgacatagatgagcctaatggtttcttataacatctatgatgaattgttgttgtcagagtgaatgggacatagcagaggaaagcgacggtggtatttggttgggtttccttttcttttcggttatcaatttttccgtggtggccaaagaagcacatttattgccaatttgcaatgagtttctcaacttttcggatgcatctcactcaattattttttatttatttatcgtggagcacgctaccttatctattcttcttttttaatttgtctatagtctttatttccgacaaatatgattgtaactaaaattttaagagagtaatatggggatggggaatctaatctcccgtccctatctttttaatgggatgtttgtgttccatattgtatttggttgaatacattaaaaaatagcagggaaaaaccaagattgtgaggtatggttggaaaataattatatctctcaaagtttatgctcgatcataaattttatcttcagatttatgtctatgaaagaacatttatcgaaggaagttaatcctaaataaatcttcatgcattaagagagtgtttgactctctatttgagatagtaaaatggatcatcccaattcattttggtttgtcttgtcattagtttgtcaaaaatgggttaaagatgggttgacctacttttgaacccttaaacggactagtcccttaaaccaaatctgttttgccactcgtactcacaatggaaactatcttgagcaaaaagaaattgaagaagaaacctatgtaaataatgtaatagtacaatccaagtataaaatatcatttttatccaagtatactttgctctaatttatttagtttataagtttcttagtttaaaagtaggaatctattctgcattagcttgaagggaccataatatataaatataaaaggagcaaaattgcaaaactaaagacaacccagccagcaattcccaaccgattgagaaaggaaagtaatagtgatcatgaaattttgatacagtgtgctactgtctacaaaatgggacatttgttaagttcatgccctttgagttaaagaaaagaatgagactggttggttcaacccatataattaaattattttgttgtctttt

SEQ ID NO: 6417 - DNA, 1189 bp, Glycine max
  Soy_ogl_4083 Gm12:34208212..34209400 Cluster 28
acgatccttttcgcataggtaattccagcaacactatgttttaagagaatgccacgttcgacaaatattcacatgatgcaaattaagtacatgtgtggtggtgagaataaggtatataagttcgagaatcatcgatcttttaagtttattaataagtcacacctaaatttactttgtttgaattcacttacctccgctatgaaatgtgtttaggattaatctagtttgaagcctagttttatgttcttatgaaaatcaaaagtactttgcagaaaacatgttcgattgcgcacatgcacatcggctgataagatatcccaccaacaaaaaatcatgaaccacatcagctgctaacaaaatccaaaccaaatgttcaaatattgtccaaattaaagtacaaaaaataatctatactaatattaaagaaaatatttcatttggtgttcatgttacatttgatagttttattcttaaatcattttttaaatttttcttctaatttacagtaacttcttcctagctacttctatatcattaatttttttattctatcacttttttattaattgtatttaactttcttattattatttagaaaatttagagagaggatatgtctctcttcccctagtaataataataacaagaagctagatactaatattctaggtgaaataaaacatgtgtaacaaagagtttgtcgaatgacttgctcctcagtttgtaaagaatgtactgtaccatctatcaagttatacatttgaaacaacaaaatagacaccaaaaacagtgtccaaatgaattgtcaaaacagagagtttgacattgtctatgttagctacaatatcatctgtgaggtgggaaaatatatatcccctgacaatgcatgccaaggtatgattgcatgaatatcttgcatcaatattacagtgggagtacattatcctacttcttttcaaagttgtttttttcctattggttattgttagagagagcttatagaacgtgacatatatactctaacactcttatattattctattttaacattttttttaaaacatgacatttaattatattgttatagaatgtgttttaatattgtcaatgacaatgtataagtgaagcttattattttttatattataaacttattttttattattgaacataaaaacatcttttttta

SEQ ID NO: 6418 - DNA, 1200 bp, Glycine max
  Soy_ogl_4226 Gm13:23523701..23524900 Cluster 28
gactttacatagagaagtagtagtctggtgtcactctgatatgagcctcttgaaattctcccatacacactctttctgtttgtatatatagtaaccatcatttgcccttctacgttgaaaagattttgcagaagaaacgactgttttcccatgtcttaagacatacatgccttttcactatatatattctgcttcactctcgaatataacccttgctaagcttaacttcttatatcttccacatatataatgtaacctatatagtttccaaggaattagtttgttcaaaccggtgttataataatcattgaagggacttgatgtagtatagagttcttgttcaactcttctactttatcaagactttaatcattcatgcacccttcactagtgttttctttctggggtcctaaaaaaaatgaaaaatatataatctgaaatttgagaaagtttcaaaatacgttgaatgcttactgattcaactacctgtttgatcaactgagcgtcctctagttgccaggtgtagttcagcaccccttgatgtaaagaacgttagaaaagcaatcaactggatcctctcattctattcatcttcaaggacaaagttttgcatcaactagcttcatttgcacatagccataccttcagccatttggatcttcctctttttttttcctccttaaatgtctatcatcaagtttttctgagttatttaattattctctttcatttcatctttttcatctctctttctttaatttttatcacaacatttgttacatctattatttttcttttctcgtcttagtttccatcatacatcccatttttgggggtgatccgtttaacatttttctgtcctttttttgttcgtgatgaccaacaacaaccacatccttcaccagggggcttctgaggtctaactaggggatgtcggtgctgcttttggaatgtgggtcatttcgttcttaattacacatgtgaaaggtatacatcaatgaaccctcttctctgattgattgtgacttggtttctgtttgaatatattctttcctagattggatacgtggtagtatggtttttgtgtttttgaaactctggatttaatttctgtgatgcttggctgaagccaaagaattagatttaaaactgtatccttgccaaagaaactagataagctagtttttcagtcaggaaagt

SEQ ID NO: 6419 - DNA, 1214 bp, Glycine max
  Soy_ogl_5647 Gm17:12107901..12109114 Cluster 28
atgtgattgtgagttgggggcaggtttttcttccacgctttcttcattttcgcaccacgtgaacaccaatcgcacttgtccccctcttactctcacctctctttctcttcaattctttgccttttttttttctttctaaactccataataaataagaaaaagaaaaaggaaagcttagatttggctacgatagtaaacggctagagccatgactcgcaagtccaaatcttaaattatggagttaagacaataaaataagtctttttcctagtcgtttataccaaggaaaaagaaaagcttgaattcagtaaggaattaaaatatgtaatctaaattcctaataagaaactaagtgttaatatttttttatatgtaagaattaaatttaaaaaataaaaaatgttaatattctaatacatatatagtgtatcatgtattaaaatttgtatactagcaatgtaaaaaagataaactcattcgtttaatctattctcttgtgatcttaatataaattcaaacattattgcgaccatcttacacaaaaatgtattattctcttatgatattttcttctttcctgccattgcacataattgaggcgcaattacgaaagcttattagccgttgtgaattgttttggttcatactgcactattatgataagtgagaacttatttgttgatttaacttaaccaagacaacaattattgacgggcaatgttaccaaaacgctgaaacagtgaaaagacgcgtggtagagcaaaagccgttttggtcccaggacacgaggaagaaacaaaggaaggaagttatttttttaacagtcatagggaaaggaaaaagaaaagaaaagttggagaaagcgacgttgttggctggggggaagaccctcgtggtgatcgcatgggtggagatttgtgtgtcgcgtgggataagggataatggggccccactcagggacaagccaaatatcatgaaaaggttatctgtttggttccaatcatgatcattggctgtgctgattttgatggatgtcacatttgacctcagccgttgatgtagggaactgattcactccttcaggtgcgaactggcccaccaagatttctgacgatttcccaccagacaccctatcgtacctaaacctagctgcattcattttcagttttacatgctcttttggtagagagaaatttattgaggtttttttttaa

SEQ ID NO: 6420 - DNA, 1300 bp, Glycine max
  Soy_ogl_6399 Gm19:36523101..36524400 Cluster 28
caaatattgggtctatacaccacgcatacaaatacacatcctctattcccttcatcttttttctaatccacatccaggatctatatttgatacctttccactgcacactcatcattcttgaagatattcccatttcttaatgtccaaatagaccatataacagataaccatatcaaccatgctccttgtgcagccatttttcctttaaagcttcccctatgctgccaaaaatgtggtatacattcccccggtaagaccctcacatcaccaaaccaaatgtaacatctcctccaaatgtcatcaccttgcagttgctaaattacgtttgagacaaaagtaattttgtcaatggatcaagactcttgtttttgcgttcattttatttttatctgttaggtttgtattgaaatgatgccgcattattttcaattgtaaaccaaatattcacataatgttttgcaaaacagaggcatcaatccgtcaagcccaggcactaatttataagaattcataaatagatgatcataggcttgtggcacgaacaaagagggtctttactctttaaacctcttcatacaattcaatgatatcttattggtaggtggaccaaaaaaccaggacaagaagattcaagggaaaagttaaaaataaaatagaaaacaagtgaggagtcaaaacaagtcgaattatcttatttatggtaaactatagtctagcagtattcagtaagcaatttaattaacaaagatttaagattccctcatataatgttcaaacttgtttttttatccatatgttttgaatgttgaattattggaatccatggatatcccacacgtcgtcacatgacaaacaacgtccaacttgggttgaattagttgctatggttccctcctttaatttccaagtacgtggtattcaacaaatgattccaacaaagccatcacatcattaattcaatttctcttattcatgtaatatattcacccccacactgcagccaatgaacaacgtgtcccatttgtgctcgcccatagtctcattttctccagaggggtcatgtctctacacatctcattttgtctagatagtttggtagttcaatataggtcactttctctctttgcagcctcatttatttgattcacaccaaaaatatcttgcttaattaacggaagaaatctcatcagtttaccctttggatccatttggtcaagtcccaatttaaatttaggtaaaaaaaatagtactttgttttttaggtaaaaaataatcccaactatgcaacgcatgcatgcct

SEQ ID NO: 6421 - DNA, 1300 bp, Glycine max
  Soy_ogl_6466 Gm19:40065501..40066800 Cluster 28
ttgagacaatctgaatatagaaacaaatacaccctaaattagaattatatgttttatgctctaatttttattcctattttgcactttatttttttttcttacttcataattatactttttttaaaaaaattccttctttttttcatttttctattttacgaaatgtgaaaaaagtcattttctttttttgtttatacaacttggggatcgagagaagagaacaattggcaaaggccgttaatacagttttcagttgagagggttgtgaagccacccacaacaaggaaaagtggtgtcacatcgacaagtttgactaagaactcaatgaaatgggttgagataccgacataacacacaagtgtgcttgtgtcttgccgaggtgatgtgtcacttatggaaggattgggttttgggttaacaaagcctctaataacaggtcatcatttttccacatattatgatgactataatatacatattttttatttttgggttgtgtggccttgaaagtttcgacgaatgtggaaggtgggaatgactgaggaaggttcctagggacactaacaaacatcacaccacagttgggtggtggtgcaacttgccatctctaaacccaactttttgcctgtggggaccttgaaatttgaaagagctccatgggaccaagttgggcacacacgccacaattgtccttttcccctctaaaacaattatgctgggtggtgggttacttgtaaaagaggacccttcacactcatgtgaattacaatatggttaaaattatttcttttacttgttttggaattgaaatctccctctttattttattctatgccttttactatcttgtttttttactacatgatatgaatatgccagtaaaaagtattcacaacataataggaatattcactacatgttttttttattaacattgaagtgtggaatttaattgttaaaagtaaaaattttaatttcaaagaaatttagatttttaagttgtgaaattttttaatatcagaaaacaaattttttttatagaaaatagcgaatttaaattaatttaactgtactttgtattaataagtttcgttcactattttcatgtgtgaaaggttggttattttctttctttcttccaattgaactttgaaacggcagcaaagtgtccagcctatgcccagagagtcagacttatattaatttgatggtgacaattgattcctgcacctttttaagctctcagaacacgaatctaaaattacattctagaatagtctttttggaatgcaaattttta

SEQ ID NO: 6422 - DNA, 1900 bp, Glycine max
  Soy_ogl_2335 Gm07:14551401..14553300 Cluster 28
aaacacccaacaaaaactagaaccccccacggaacacgatagagtttacactggccataatggcattcaaaatgaaagtaggaatagattcaaacagatgaacctgatcatctttaagatagaccaaaattagccaacctatttgttacttgatttgcttctcgcaaaatgtgagaccagttaatgtttcctccattttggatgacttctttaatgttttgcacaatactagagctggtgtgatgggtagaacatctattctgaaggagatgaatggctacttgggaatatgaccccataaagaaagttttgtagccccggctccaagctatccaaactccaatcaagatagaccaaagttccgcatggataaccgaacagaatccaacattatgagcatagcagaagagaacaaatccacattgaccatgaagcacacctcccgctgcaaccttcttagttcctagctgaaccgatccatcacaattaagcttgaactgaccagcttgcacatgaatctatatgataatagagttagaacctcgactttcttcctgggtagtaatagcttggttacttttaatgctcaaatccactgccaccacttggtgacaaatttgattgacaatttccatcggttgactgacatgtccttggaaaaatgaatttatttctagcataccaaatcttatccacaacaacaaaaatacactcccctgttgaactgttgacaaaaccaaatattgttgaggtttgtcatgagccaatcatatgtattctggacgaaaaaattctgatacaaatataggccggaagaagaatgtaccacacaactctggccactacacgtgaccaaaggatatggtccacattttcagtctcaaccataaattttgcaagatttatctactgtcaagtgtcttaaaaatatggattcattagttaggaggccattgacaacaactttccaaagcagtactctaatcctttcaagacccctccagccccaaatagtaggcctgaggctcgaattgagaatactaaagactgtttggaatggttatttgtgtatgtgtgtgcgtatttggttatttaatggaacttctcataatgttaattgtacataggagagcatctaggtggatgcagcctagcaattgaatatgataatggaattttctgaaatagtgaacttatggggaggtttcaatgtcagaaaattggccagtccttaactaatatataggacaagtattccttgagtgcacagacactaattaggagattaaattatacagaagttagttaatgactaagctatcatacataaccaaaactatagtaaatatagttccatcgtttaaacataaaaaaaattggcatagtatgtatgcagctaaaaaaaatgcaatccaaaattttcttatgtagatgtttttggactagcaaatacattgtttgatagagtaactgttggcttgctaccttgccacaaacagtcctactaaataaatacctaatgagagaatgcatgaggcctcaaaatgaaaagacatctttggcactgtccccattgaaatgtatgcgataatcatgtgttcatccatgtcaaaagtaagtgatatgtcatgtgactattttctgagaccatccaaattaagggaatgtgatagtgatatggtccatctaagtttggaatgcactcctggtccatcagacaggatttaatctcctatactcatagcagagaatgtcaccaattgagtttcagcagaaacatcattgcaggtacagaaatccgcagcatacatctgaagtaagaaagttacaatagtaatatttaacaagtttgaatttttgagcagtaattttatgtattctctaaattttgtaccaaaaa

SEQ ID NO: 6423 - DNA, 1800 bp, Glycine max
  Soy_ogl_3088 Gm09:30431601..30433400 Cluster 28
aaacatgaatattgtagataatgaaatttgttatgacaggttcaatttataatcatcattattggtaaatatattggcaacaccaaattctgaaaggacatttcaagggaaaaaatgggatatcgattatttgtttaggtaaatgaaaatttaattactaataaaatcaccatcttaatgaagtaaatacaatacactttaacacaattgcttacacctacaaaacaaatccaagtaaataccaaacacccaatataaggaccatcttaattaagtaaataccaaataccaaactactcattattaatgtctttttcacacaaaaaaaattacaaccacttaaaatcgtataaaagagtcgattacaatttactttggtcccactactttaatttttgcggatcgtctacaaaacccggcaatatcttctttgatgtatgtctcacttttattgagtctgcaaaaaaaaaaaaaattaattcctagaatatttttaaaaatcttaaggcatggattttttaaaaaaataaaaaaattgtttgacaacatacaaaagatggtggtggaaaaactctgttagcccactcactcactttcttccgtttttaaatttctggttcacaaaaacattatacaatacacatacacaccgtgaaaccctagagcaagaactgatggtgatcaaatacgcggtgttcgaaccgcgctctgcagtggaagcccgcatagactccaacagattcttattgcattaccacaacttttccgagagagcacttgccaatcttcaccggccccggccacttccccgccggagatcgatcggaaattcaagtccggcaacagggtggaagcgttctgcaatcatcgccggtggaaaggtcgtgtcaccaaagatttagggaattgaaggttccttgtgtctttcaatgactcagacgagactgagtttccaaaagaattgctaaggacaccccgtgagtggattaatcaaaattgggttactccgttcagaaacctaaataacaaggacatttgtggaagaaaaagaaaattttaagaaatttgcgtcttgggttatttacaggtgaactgataccaaactccttgacaggctccttaaacatgctcttaattataacgtgcagaacttgaaaatggatatatttgagtccctccctttaatcttttgctctcagtctttgacttctcttaagctttgccatggcgtaaacccttccctcgcaatacttccgaaatctctgcacttgcctgtgttaaaaagcttgcatcttgaatgtgtcaaatttactgcaagtgacgatcactcaactgagcccttttcaaactgccatgtgttgaatactttggtccttgaagattgttctttgtataatgatgcgcaagtcctttgcatatctaattccaccctttcaagtttgacaatatctggaagaggaagacaactttaccagattgtgttttccactccaaatctcagtttatttttttactatcaggggtgttattagtcaccaactcttctctgaattgaatctttctttacttgaagaagtgaatattgatgtgaggttgggtccaagtaaacatgggaaaagtttaatgatcatggaatggctgcaagtagtggccaatgtaaagatactgcaattttgtctgggtgccctacgaaaaatgctatatgtaagttgttttagtacattttcgcttctattcttctttaatgtttataacatgtttgtgtacacatgtcaaaatatttgactattaaatgtctcc

SEQ ID NO: 6424 - DNA, 1200 bp, Glycine max
  Soy_ogl_3386 Gm10:6289101..6290300 Cluster 28
gtttgggcggattcacgcatcttttttttagttccaatcatttctgtaggaggagcagaagtcttgttcactcctttccatctcagatgcttcctcttgccagttgggtttttctttggcttcatggaagcatttagatcacaggcaagccctactttcatttcctgcctgactacaccaatttcactgcccagatgtacagttggattatcttcgactgcataacttcgaactcttgctctttcatcaaaatttacataccctggacacgacgtttgggcagattcaggcattgtttctttaatcaattctccaggaacttctcttggaggagcagatgtcttgttcactcctttccttctctcatacttcctcttgtgagttgggttttcttttgattgaacagactttggtgtaacaggcttctcagttctttggggtttgtcttcttcaatgaccttaagacgatgctttcttctccttggcttgagttgcgatggtttattaagatcaataccatgactgcttcccttgtccgacttgtgattttccttgaatgttgaagaaacagcagcaaattctacgatagggtcacagagttctttgttcttttcttccttattgatttgcattgacgttatttgtctgctttcttctttgtctttgtcagcattgtcaagcgtaaatgggatatcctgagaatttctcttgctacagcaagcaatgtatgtttctgtgtcaaaaaagagattaagcaaaccagtcctagattgatcaagtattaaaagtaaactaaaacagaaactcattgataaggaaatgatggatattgtgcctctggagcagaaagttttatgaatttcatagagcaacatggtctcaaggttgataagtgttaggcagaaagatgcatgcaagggccaaaaatagaaggacttaccatgaggatcgccggtattgtcaatgatgaatgaaggaacaaacggtttcttcaatctatcattttgccctacactagagttccttgcttcagcctcaaccgcatcagaagctttgccactgtcaacagcaactattggtttctcagagccaagtgagaaatcaatacatgcacgatgataacccttttggtttttctccccaagcgtgtagataggcactggttttagaataactggcttaaaaagcgtggcgggtatc

SEQ ID NO: 6425 - DNA, 2100 bp, Glycine max
  Soy_ogl_3409 Gm10:8406501..8408600 Cluster 28
aacatataaatcaccaatgtcttagttctatccttttttttataggaaaacttagatctataattaattcttacttgattacgtaaatctaagtttatagttcaaatatattacattattcccctttatcctttataataaatatcagtcattaactgtataagaagcagtaaaaagaaactgtactagagaagataagattcacttaagtgagcaggatttttctgtaattagataaaacaacagttataatttaaatctttatctagatagcataatatatcttcttttaacggctaagtgaatcataagacgctacaaaatcctgcttcttctcgtcaattctaaaaaattcacattgctgagtctatttccgtgttttttcttcttcacaaacaagaaaatcatcatcatgctcctcccacatccttcgattgtcacgcgaccagtgttgtccttcaaccttgaatcggagtttgagttcatccgttctgtcattgtctcccaccctctcatttccatggacactgattttccaggcgttgtcgtgcactcccatcccgctctccggcaaccggagaacaactatgctgtgtcgaaggctaacgttcgacgtcacgtgcaatccccacgcccctgactccatcgcactcctccgtcgccagggcattgattctcacggtggctgggctacctgttgaaggcgttgagccaacgtttctagcctgtgcatcctttcttgcccgagagcttgcgccattttctgcagcttgtttcttcggacacagagtatatgatgtgaaacatttgatgaagttctttcctaacctctacggagctttagatcgagtttctcggtctctgaacttggaacgcagagttgggaaaaaccatcaatctggatcagacagcttactcaccatgcacatctttaaaaaaatcaaagatgtctactttgccaaagaaaaccataatggcatggtcaagcatgcaagcgtcttgtatggcccagagattgtctaaatttgtacaaacatttgtttgacgatgtaatttgatgaaatgtacgttagcgatgagatattttaccaattgtttttatttgaattctattgtttttctttttgtctaccaagcttgattatttccaagtttaaactgatattcttgtggagaaatatcaatattttcatttatctaaggggatacactttcatgcatttgttgaaaagtaaaaatgaaacattaaggcatagttaaaaaagaatcggtctcactctgactttctaacgctatcaaaaaaagaaaatctggcttcctaaaaggatgtggactctagatgtaaggacagtgacatgctttcctctttgcattcttgaactatgtcactagttctgtgcgcatcatcatggttcatctgttatgaacttattggcctctagcacactttgttcatccacaccataagcctttccaatggacttaatagtaccaccaaataaaccagtaaagaggtgacccctcttgctgtctgattttcagttggacaagcacataacattggaactgtgagctcagcaccaattgcaatgttgataggggtatagtaattctgacccatcactgcctgacatgtggtgaggccttggaaagtttcttttaccaattcatagtaggtgccattcttgcaagcaatgtaaggtgtgttatgctggtagatgtttcctgagcgtgaacagaagacaggaacaatgattgacttattggaaggaatcttgtcatttcttcagatcttgttgattgaggctatggtagatgcctcagagccaagaaggtaagcaattctctgagggttatcctagggtggttttgacctgaaaagtaaaaaggaatgacttctgaaggcctttgcaaaggtacccttttgcaaattataccttgaataattgagtatttcctattaaaaatactaaattcaagtttcaaaaacaaatttcaatatggataaaagaacttgacttcaatatgctatctagaattacgtaagcgttgcaagggagttaaattgccaagctatattactccacaagtcaacaattg

SEQ ID NO: 6426 - DNA, 1058 bp, Glycine max
  Soy_ogl_3434 Gm10:37661543..37662600 Cluster 28
taaaaaagtcgatgtatggatcactaaaaaggtcaaaattcttgttgagctgctagatgtctgtctcttgtgatgtttttttaaactaaaaatttaagataatgattgaattctccaaaaaaacatttgtttcaaaaaaaaagttactagaaataaatcatgttcaaaacataagaatttgagtatttataagattttagtcgtcgcttggcgcaggagttgtatttgatttgatatacctaccatacttgactttgaagaatctcgatgatattattgagaaacatcaatcatcattagaatatttttgttttttgttttttattttttgggcatatttggatattctttaaaaaaaattaacagaaaaaataacttttaaaacaaccactacgttcaataaaacggtcttgcaaacacaacctcacctaagtaatcggtaataattttcatgtaaattggtaaagaattttggaggtatggacagatgaaagacattgttcattttgattaagcatctcaaacgtgaagtaaataataacaaattcaatatatttaaaatctaaaaaatgatgaatattttatcattagaactttattattaagaaataaagaagattgatactggtagtgggcattgagtgaaggaaaggagagagtgatgggtgattgattgattgaatgtgtgagtgttggattcattttaagattgagtgggtgaatgaagagcataaaaaggtgaaagggctctgagaagtgaggtgtgaaaattaaaaagagtgacatgaataaactcatgacttgaattgaaaggaaaacacagtggtaatcatgttgacaacactaatatacgtgttttatacagagagagagagagagagtcacaggctaaagatctaatcttgctcccgtcatccacgatgccgtgaggacttcatctcatttttcagtcccttctaatgtcactgtgaatgaatcgtggtaggacttgggattgtcatcaacggttgttaaattcaagcttattcacgggcctaaacccatataactcatgcttt

SEQ ID NO: 6427 - DNA, 1400 bp, Glycine max
  Soy_ogl_4307 Gm13:27598701..27600100 Cluster 28
tttaatttagtagttgatattgatcattcttattatcgtatgagataatcatttgatgaatttaatatcacccaaaccaactattagtgagttttttcttgaatgaatctctattagtgagttttttcttgaatgaatcttgtgatttgttttatttttttactaaatgatacaaaattaaaatatagatctttttatttcattttatccgtcttttatttttttactacttttaccttgagtcaaacgaggaataaaatatttggttacagcaggattttacaagagcatataatacacagtaattaaatgcaaatgtgttggtacgagttggtggaagaaaagtaagtagtagtacgttgtagagggtgcagggaagatgattgatcgacattgagatattgagatgacgaaaagtacgatgaaaggctgagcctctacacccagcaccccgcgtaaaactcgagggttctctcatctcatctctgccacttcactttttcacctctacgcgctctagggttggcagtgactaacgttattgagttttgtaccctaccctacccaatgggccctgccagaatgagttttgtactttaatggaacccgatgtgggcctgggttttttttgggtcgagggggaactaagctacccctaattttgtgggacaagcacttggggcggtggagtgtgatgggagcgtgcaggttcttgttcgggtaagaaaatgaagagggcacagtggctatattagagagggattggttggtgaagagaaaaaaactgtagtgggggggggctgttttttgatgtgtgttgtagtatcgtgcctcttactgcagttgcagccttgcattgattgtgttggtggaccaaacttggaaggatgagggtgttatgtatttggaatgtataggtcactttggccaagactcaatgaaagtgcattgagagccatttggcatctatagaagaggaacaattagaagaaacccttctggtttggtttggggtcatcaccacatgtcgggataattcatggttaattttttttttcttttaccaaggtatttctaccgtaaaaaattataagattaatctctcattgaatatagtaccaattaagagataatttctctcctcacaaatgctattttattcacataatcagtacaaatacaacacgtgtgtctaatactatacatatatatgatatatgatgatatgattattttaaaatatataagatacaatacgtattaaactttcataaaatactttaaaaacttgaatatttcattaatacatacggcaatacatgtgtcagcgagtatccaaggaatataggtattaaatacgtgaaacaaattgaaatatcattgtttcataaataatcaag

SEQ ID NO: 6428 - DNA, 1009 bp, Glycine max
  Soy_ogl_4374 Gm13:30975501..30976509 Cluster 28
taggtaactggcaactaatttaagttatactaagatagttaataggttaatggcgttgtaacttcaggtgtcatttgtgcaacttgcttggaaagggccatagccatcaaggctttgaccatcacgagggcattgctctgagccacacgcgatagggcgattgcatgacgagtagtaatcagtgtcacggtcgtaccataagttttgtcctgaaagatcaatgtctaaatcaaagttgtgcctaggagtatctatgccaactgaactatagtacaaatttgttgcggggtctttcttaatgggaagaataaaagggtgtggtttggtgttgggagcttgagatgctgataagcagcaaactgagaaaagagctattgagaggaagaggaaatggatgccaaaagaggaagctattgctaactcaaaagatactaattaatgaagggtggtatattgatgtgtcctggtccacaatgttgactctctctttcatagcaaggctgcaaggcatatcagatggaagaagattctttgcagtttttttaaaactggatgagatcctaactgattattaactttaatatttttagataaaaagatatataaaaaaaatcaatgaatgatgagatatttatctccatttttttatattaaaataaggtccccatcatatgttgcatgaccgaagcttacacgcacgttgccacttgccagttgccaccgccaccagcatgcgttgatcagcttggcaatatcatgataattattattaaattgtgcacccacctatcttatcgttcttttatatactttcttcgcatttcagtctttgccatataaaaataaaagtaggattgccaaacaatatttcttaaagtcaagttaaaaaaacttccttatttttcttattttttgtcaatagaaattaaacatattgtaaaaatatataatatttacctatcttactcaacgagtaacccattgataaatgaacttccttatgattatg

SEQ ID NO: 6429 - DNA, 1400 bp, Glycine max
  Soy_ogl_6690 Gm20:1925101..1926500 Cluster 28
ggaaactagcataagatcttgacgctctagctaaagtgttaacaataagatttgcttgtctccgagtgaaactgatcctatagttgttgtgtgtttgaggtaatctctacattttgtgatgatgtttccaaactcagtctgctgactagagtcactgtgaatggaatctaaaacctattgactgtctagttcaataatcacataccaatcccaaaacaaccttgctggttgaaaagagtagcgtcaatattacattaattcagaagggtttgctttggctgacatgttgttggttgccacttttttgtacagtatatttgatgttgatgtatagagggggttggcaggggcccaaggaatccaaaattgaatctgcagtatggaaggacacctccaaatgaggtccttgttgaggagttgtgcaggaattatattgcatgtcctggcctagcctttagctttttagttctttttgttttgcttttcatttcactcatgttaatgtaccaaaataatcaaattatctttcaatagtcttcgaacttattgattgcaaagcaataattgaatcctctgcaagtccgcaaaaccatcattattttttttatcaataaatattaatttttttaagtaaacaaaaccatcaccaccttagcctaaacagagaaagtaaactccaattttgcatgcgatgaagtcaaaacgcacatcatgatcaaccattgtcttgccccactccttcatcccaaacatttgtataaatatctaggagtagaactgaaaagactaaactggtgagctgactggacacctatcttagccaaaaaatcagcttattaatttaggtttatatgagtgatcatatcaaagaaaggagcttaagtttcagattttaattttcatgaattttactaccggtataaaagattctataaatgtaaatcaatcgatttatataaaaaaaaatgcaaattaatgagagaagtgctccctttaatgcataaatatgcttctatgtatcattcaagcaacaaaggacaaactgcagctcaattggaacttgtttctgactcatactcagaggggaaggaaatcaatgtgttaacttcgctaagttacatgcaggtgtcctttttaaggacgtgattttccctttacacttcacgtgccaaaaaaagaaatgtaaattaatcagacattacttttgagatatattaattactattatagattgggctttatggctgagatgcatgcatgacccaccattctttcttccttattattaggttgcatgtcaaatcatattacctataaattatcattctcttatttttatctttttttcatcaaaatatcttttcaacgtgtatcaccagtttgtatgttagttttttatt

SEQ ID NO: 6430 - DNA, 1300 bp, Glycine max
  Soy_ogl_2329 Gm07:10531701..10533000 Cluster 28
cctacacatcccattattatggcatcccattattatggcaggatgtgttgtataataaataaaaataataattagttaaaagcaattgagatccatttaacacaccttagcaaacatttccaagctcttaatcatttcagaagcaaagagatctcatgtttcttgtatataactcaataaatctgaaagttgacaaacttgcaacttgtaattttcaattagctgacgtcttgtttggatccatagttgatgcttagatcatcaggtgcaaagctgacaaattgcaacttgtaatttgcaattagctgacagcttgcaacccttttgttttccattcaccatcactagcctagtcttaccagtcttgtgccaccgggtttctgcaccttgcaagtcgtattcattttgaatctttctcctctttcttatcccagttgtgtaagcctttgaaggtctatggaagaagttcttgctcaacccatctcttgttagtcctgttagatgcatatatgaataaccacccaacccaaaatcaaagttaggtagactgaggtgaactgaaaaataaaacccttatgatgtctcacatatctctagttaaaccaagaaattaagggaggtgatttgaattttttttttccaacatattttcacagtgtatagctcacattaggatgggtataacaaataccatcttctccttcaatagtaggaatgagcttgtctatcaaattaagacggtgaagcaacaacctttaattaaaaaaatataatactcaaactcacgcattttctatctctgttgatgaaaccagatgccttcaaatactatttgaactccctttttaaggaacaatccacaacttagcatgtctgaggttgttctctatattaaaagagccgattgagatccatcaaaacataaaactctaaaaaacgatcaacaaattaaggaacttggatgcaaaaaggccagaataacaataataatatggttaataattttcgtgaccttttaagaactatatacgtattaagaaattatatatatatatatacttgagcagatgctgatccggttgaggaaactagctagacaacaatatatgtgaacaaacgaaaaatatcttgaatatagacaaaaaataatgatggaaaatattagcctcctagcatatacacaaccattaaagagacgaaaatcagtcataaagagaaaaaatcaatcctaatgatgggatctttggtggactcctaatcaaaatcaaaatcaaaacaagcaatttaatcaacaaacaga

SEQ ID NO: 6431 - DNA, 1300 bp, Glycine max
  Soy_ogl_2301 Gm07:9036101..9037400 Cluster 28
cagatctctgtacaaaatagtagcatttatcacaagaggttggtccttggatgaattttagtaattaactctataaaatattagtctgtaactcttcacagaaaaaataatgtgatttcgtggaccagaataatttactagaatagagtatgtagtaacctatgatcatgtatgagacgtgggattaattaggcatgctaatgtggctagttttccgaaaggggtatcccaagagagtataatatttgtcaatttccatccccggaaaatttaatggaaaactgctccgaaaaaagaaacatgaaacgtgattacaacattcttttcaagaaaagtattttatcatatttttccttcatgtataagaaggttaattaagagattaaaagaacttgttgcaatcaaggttaaagtacatgtcacgagaataaataaaagccaattgagagagcaatagtttcttataactgagttctccgaacattcaaattagtatagatcccaaaatgaccttagttaaaaaaaaaaaaagtgagaatttttaagtctgaaattttttatcttccacgtctaggcatttctatctgcacagacgacattcccctgcagcacgtgtttagtctttagtcttcgagcatatacctattttaaaaatgccaactaatttatctccgaaaagaaaatgccaactaatattatggaatttcgttgccttttaattgtttctactatttgttaattaattcttaatggatgatagtgataggtcccctcaccgaatcatgaagagcaagcaactcttcaagaaggttggtatcacactcatcccatgttcatagggtagaatagataagcatacaatgcttcgaagtgaatttataggaagaagggaattatttattgagtccctgcaatatattgattgaacgaatgacaccatagaatgagatgtcgaaattttttaattattaagttttaattaacaattttggagttcagaaaattagaagaataacatgtaatttcataaattatattagaatatgtgtcacaattctattgaataagaaaatactaatttcctcctttctctatatatacaatttctagttctagcaaacggaaaaattaacttccattgtgatcacttgtcaatatcttcatagagcaacaagttaaaaagaatatgaaattccttatttttactaacataggaagggagtggtgattagcatatcgcaatatattgcaaggatataataatattcaaattctaaaaaggcacctgtattaaatacat

SEQ ID NO: 6432 - DNA, 1000 bp, Glycine max
  Soy_ogl_5992 Gm18:8441601..8442600 Cluster 28
ctgcaaataattatagcaagaaagcaaatatgaaacaatatgaagaataaaaacaattagtatgtaacattaccatatcattgtggaatactgcagtgaactgtatgattaatggattagtgtgagttggatattcaatctgcagtgagaggaaattcaaaaatgaaaatcaagtatgacactgaaataggaacgtctaaaatatgtggagaatgacaacatattaaaatgaaaaaaagttgtatgtacattgtttgtgacataaaggtttcattttgcagcattcttactgctgtaaatgtgcctttaatcttttggatcaaacttttagggtgatactcatgccaaacttaacaggatgctgagataaagtatctttcgactactggattaacaatcaaataacaaaggaaattgtagattaacaatcaaataacaaaggaaattgtgtatttgttgtctgccggtaaaaaataaacaaagcaatctttataacagttgataatagtaatgagtcaaaatatatccgtgcatattcaaaacataaaggaagaaagaaggcttggttccatagccagatcagaatagcaggagacaaagaaaaggcaggtatgacaaaggtcacacattttttcaggctgaacagtcgaaagcaatatacataaaaaccaaataaaaaatttaaataaccaaaaaaaaaaaaacaattacatgcaaggggctgagaatgaaaaggaagtaaaatacaaaacaaaaaactaagccagtaggaagcaaaacaaaaacccatgtgaatggagtgaaagagtgaatggagtgagaacggcaatagaagagaataagaaatggaaaaaacgcaggagagaaagagtggacggagcagaaacagaaaaaatccaggaaaacagagaatgaacaatgttcaaaatattttgagagagtaagcaagtaattggtttcacatgttccttgcttgtagctgttgatgaatcagaactgg

SEQ ID NO: 6433 - DNA, 1200 bp, Glycine max
  Soy_ogl_5366 Gm16:29487401..29488600 Cluster 28
caaaaaaaaaaaaatcaactctcttttgataaactcatggatccgtctccacttcccatgtagaagtttttaacctataaaattggtttagtgatgaaaaaattaggataactgcatgaagatttaggtttgattctcattgtaagaaaataaaaagaaatacacaacattcttgttgaaagtaaattaaattaattctaagcacctaacaatttggcatcagttaaatatgatcctttgagaggtctgtctttatcgatcatacaactaggagagcagagctctaccacaacaaatgtacatctcattttgaaaattgttcatcatcatcagttaaacaatccatgctttgacttcatgtatgattttgagaggaagaacgacaaaattaatatcttggccaataaatctggagccagaaaaatataccaggaatttaaagcataactctggatacatcataatttgcatactacttggtacctcattaatagaattttttatttgccttccaaaaaaaagacatcataatttgcatacacagctagcatgaaatttccaaaaaatagtttttttaatctttttgtctattagtagatgagtttattaaaaaaaaaacacggcagaacatcataagagaaattccatgcctcttgaatggcaattttatgaacactgcatgtgaaacgaaggtagggcaaattcactaggttagggtagatgaataccagccaaaaaaaatccaatagtgccagaaatgaagggtctttcaggatgcaaatgacaagcatgcagaacacaacagctaaagaaattgcaacagcgacgttatcctttcaaatataatgccatcaataatgtcctaaatcctaattaacatcttcaacgcattttatacattaataaatctaatagaaaattaatgatcccacgaccctacatgacatgggattggaagaaattcaactttgcatttctaaagcagagctaattacgttagtgaccatagtttattccttatatttttatataatatacttattatatgtcattggtaagtgccttaaacactggaagccgtaaagatgggaagtacgaaagcctcaagacgctaacatcttctctttgttttttttttttaaatctcattgtgatttttttttttcccgttattttgctttattctgcattcaaataggt

SEQ ID NO: 6434 - DNA, 1500 bp, Glycine max
  Soy_ogl_1338 Gm04:41538401..41539900 Cluster 28
tgtttcaatcccataagaaatatgttttagtcgggatgattttcattaaaaaatagtttgcttcatatatacataaacactgaagccttccatctacatgagccattggtttttataattttcttttgaagtgttagcttttttattccttcatgttaagcaccaaaaatgaccacaaggtcaatggatgtagaaggggaactgtatgcaagtgcacagaattctattccgtttgtgtgaaggagagtgaaggggtaacactgtaattttgcttcaacagttcaaatttaaggaccatccaaaaaatttaaatatttggtcgttagtacttctctccacccaaaccagtgaaaattttgaagttcataacttctatcctattctactcacttccacaacatttcgggcctcccaaacctagccaaaagatgttttagtcataaaattatttttattgaaaaatttaaaaataaagcataatatatttgcatctttctaggagaggagcctatatattattcatggtgagagtgccacaataactataaatgttaaggaaataaaatataaaaaatatattttaataactttttaaacggaaactaacgaaactctaacagaaaatagaataaaaattcacaaaaaaaaaagaaaatagaataaaaatgtcatatactcaattctgtctttgattctgatgtactcaactctgtcatgagagacggggacaatgtaataattaataatcgcgtgtatatttaaggagatgagagtgtaatttattgttaattttttcttgtaactattttattatttttttaatgtagaattagctgtacggtatccctgtataaataattaactccggaaacaaaaaaaagttactcgtaaaatgactaaacagaaaatggaagaggctttctttttctttggttctcgttgcaatgtgtgtggcagtagggttgggactgagtgtgaagctcagttcttattttgaagtattttttagtattgatttaatttaaatgcaacaaaataaaagcatgttattttttaataatatttataaaattatcattatcctttaaattatgatgatttttcgacaactaactttaaatgtgccttgtaaaaaacactttttttaatagggaccatagatgtggtcgtcaatctcgaacacaaaattggggatttgattccacgttgtgcaatcattgtgtgttccacagtttcaactttcaaccactgagaacatgcatgtcatgcacatatataaccaaccttaaaaaagttcaacattttctcgtgataaggagggaaaatcttccaggaacatgcgtgcagtgccgttagtgttgagttgtttttccaaattgctgactttcatggagacaaactagccatgatcgatgtattcatactcatttgagccaattttggatatagacataccaacctcccatgggtttaggattaattagctagctaggtgcagtg

SEQ ID NO: 6435 - DNA, 1100 bp, Glycine max
  Soy_ogl_2771 Gm08:19813001..19814100 Cluster 28
aagacaataaatgatatagatttaattaaaaaaaatctactccatttgacacgtaataattgaaatgattgatgagagcgattgaatactgagttagctactagttggagtggaactatttttctttatcattttttatttatttaaaatataaaaaaaggaagaagaattgaaaaagtgcataaagacgcggggtgccaaccatatttcttcctatcatcttcctccttagcctcacctctcccattcccaatctcaatcccaatccaaacatgttagggttttcagtgttcaaatttccccttcctatttcttcaattaacataactcatgcaacatgattccaccaccttcaccttcaaatcccaatctttacttttcaaattaaaaattataatgataatttatactgtactatacaaatagatatgttagaatcacgtgataagcaagaaaaggaatgacttacccctctttgcaagatatgatttccacacgcacacgctaatttctggtgatgatgacattgttattgctgcactttagctctaaaacgttgctgtcaactttaagctgcattaatttcaacaaaagcataactaggaattggatttgacctcaaaagtgatgcaacgggtggaatacagggatccaagattaaactcaaatagtgccaaaacttattaaaaagagaaaggccaagaagagaaaggccaatttctgctatatcattgattgatcatatgagtgcagagagtgattatatagttgaggttaattgtaacaagctaagtgttttttttatcaatattgtaacaagctaagtgttttttttacattgatttcttgtttcaggtatccaatgatgcttctctgctggaattacttggcttatgtagcattagtgctttgaccgatctccaatgttttagattatatatttttaacttaattaaaacaatatttttttcaatttaaacaattccatttttccatcatttgataaaagataaaaaaaacttaattgagacttgttaaaaaatataaaaacattttttatatattttttcatttcgtgtttctttctaactaattcacca

SEQ ID NO: 6436 - DNA, 1128 bp, Glycine max
  Soy_ogl_4031 Gm12:9476401..9477528 Cluster 28
taaaaagctacgtaattttcttccatgaggagagggtaatacctttctttctgactatatttttgttctaccatttatcatttgcagacggagaaaactattcagtaaatatttctatatgtcacacatgagttttgacccaggactttatctatataaaacaataaagttttgttaagttgaaaaatgttaacctagttggttaattagttaatacagaaacagtcatgctctagaagtacatcaattctattttcaaatcccaggaaagaaaccttttgtttatttattctgagtaatattttactagtttatgtaccagaaaccgcgttgttttgatacctattatgaggaaagactgagaatccataacttgacctccaattctccatgaaattgaaaaatgtctactcctggctcttatcaatttgcacatgatagtttgaaataaacgacaaataataaatcataattaaatactagcaggataaatctatattaaaatcgcaacaggggaatcctcatgctggtcaatgtctgaattattctgctttcgtgtatccataaactgacaaaacgactgccaattgcaatctagctagtgattagctcactacttgtaacgtacgccgtgcgtacgtaactgagtatgctgataataaaaaaaatgaaaggaaacattttctcgtgataaaattataaagtgagtatactacaccttagtgttgctgtgaaatttttcaagaaaatcaaaatggatatttgacggaaaggtatatttcagtttttgatagtcctagaaagaaattgaagtattagaaaaaaagagtattgtttcaagtatatctattaacatcaagtgtcatttttcataaaaagataaaatttaactctttttttattaaaagctaacaacttattgaaactttgccaagtattgtttaaaatttatcatttatttaatctactatttcatgataaaaaacaaagtgaccgtgtgaactaggtttcttgaagtaacttaaggtgtgaagctcaaaatggatagtagtccttttgctgaagttccataagttagtaaaataagtttttttaaaaaaaaaaatatttttgctaccgtgattcaga

SEQ ID NO: 6437 - DNA, 1000 bp, Glycine max
  Soy_ogl_4168 Gm13:13193701..13194700 Cluster 28
acaatgacagtagctcatccagcaaaagttgaatacccacgggttgagaccagtcttttgcaaacatgaaggatacttgtttatagtttagaagctacaaagatttggcctttccagtttggcgtgaaccaaagtatatgaacgaatgaatccatcatgagcagcaatatgtaaactgcgaatacaggataggaaagtttttgttgaatatattctgaaaggaggttgagggcgcttatatgcttacaatatatggttgtcatgcattattttttttcattagattcttgcaccaaggtttgtactgtaataatttgaagataattgactatttcttggatcggacaaatattttctcataccaataaaaagtgtaaattgaggtgtttcttaattttttttaatgttgagatttgcaagacactgaactttcttatattaccatatttatctttattcatgcacgggaatccagtattttcttaatatatgtaacgccttccctatttgtatatctcacactcaaaaactacgttcaagttacttgggattccgaattttcacattaaacgggtcctacatataaaagttacatatacaattagccacaagaagcgtactttgattatgcaagaaagaaaaacaaaagaaaatagtttttgtgaaatttaacgtattagtttttggttattaaatcttctttattaatattatgtcagaagtttttgcgcatttgaatgatggcatcattcatttttcccctctaagcctgtaaattttttttgtggaactctaagcctgtaaataagtacatttaatctggagatttcccattctttccatttccaatcttctatcatcattccgacataaaaaaaataatccaaaataaaaattgtaacatcattcaaattgaccttaataaatgtaaatgcactccaaaggcatcatcatccatgatgatcatgttgaatttttttttttatcttatcaaaatgtt

SEQ ID NO: 6438 - DNA, 1100 bp, Glycine max
  Soy_ogl_5152 Gm15:48193201..48194300 Cluster 28
gtttgggtaatagttgtgaaggagtaacaaaggaaagagtgaggcatgagttaaatattataggttacataagtaagaatagttcctagaaacttagtggcaagatggatcatgagagttaagaaaacgatcactgagataagtcaacctagagccctaaagtttatatgctttcaggttaagtctatgaacatccttgaagaagagcttacatttgcttgctgagagtggagaagatgttgagacaaggtctcccaatgcatggaattttagtttagttttctatatctttctttatgttatgtgaggcattatgtgccaaagtttgtaataagttttatatataatagatttatagtttaaattttgcttgatctatgatgttttttatatttttgaggcacatgactagattaaggtagtatctcctaaggtgttacatgagtcctatatggggcaagtgtagagcaaaggttgttctcggtaaggtggcggaagggtatgattctagtaaaagaaatagaatagtgtaatttaattaaagtaaatgtcaaagatcgatatcttggaatgtttgtaatcttagatatgaccacaatagagtaaagttataaggtataagtgaaagtgatatttggttaagaagagtttagtccacccacaaagtccttaaagcactaactaattaagacattgtatctcatttcattaagtttttcttttttttttcaagaaacaggtgaaggtgcttgtcgacggaacttggagagtccaatacgaaaagatgtagctcaactctagttatgtttttgtgtctcccttaagttttgtacaacaattatttgacttagtgttatttttaaaaaaacaaactcacgatccataacaactgttttaaaaaaaatgatgttaaatagcaaaatatgactgaataagatgtattatgcatgtatggaagagaaagaattcagatactatgccacatgacactgaaactaaaacttcttgaatcaatttatacaaggtataccagaataatagagtaataaataaaagataacatccaaaatggagaggggagactatgacaaaacttactc

SEQ ID NO: 6439 - DNA, 1200 bp, Glycine max
  Soy_ogl_5713 Gm17:30800401..30801600 Cluster 28
tctgaaaggagagaagcataaactttgaattgaaaaacaaaaagagagggtatataagccaagcttggttactgcgattctaggcccatcaattcaaccaaaataatcaaaaacacagaactgtccttcgatgattatttaaatagactttaatatgaacgaaattagctactgcctctatactaagttttgtcgattagtagttttagtactgcaaccagcaggttcataaatcaaaattccacctcaaggtccatccaaaataactgaaatagttaaattcaagaaacacggatcaataatggttatgcaccaatctgttagatccaactaagctcaaagagcttttgagcaattgaaggttcatagacatccaacaatgctgaagcatatccaacctgaagcattttacactatgaaaccaagatttactacaattttagcaattcccctcatgtactgagatctgaatgaaagcttaaactccaaaaacaaatccaatgtcccctaaccccaagtgaaagccgactttaatatgaacgaaattagctactgcctctatactaagttttgtcgattagtagttttagtactgcaaccagcaggttcataaatcaaaattccacctcaaggtccatccaaaataactgaaatagttaaattcaagaaacacggatcaataatggttatgcaccaatctgttagatccaactaagctcaaagagcttttgagcaattgaaggttcatagacatccaacaatgctgaagcatatccaacctgaagcattttacactatgaaaccaagatttactacaattttagcaattcccctcatgtactgagatctgaatgaaagcttaaactccaaaaacaaatccaatgtcccctaaccccaagtgaaagcccaaccaatgctcaaaatccactcaatccctctctaacccacttaaatttaccaaacaagtcagaataaatatacagaacaaatttaataaaccgttttgctcctccacaaccccaatttgctactacaccaaattacacaaaacaataaacccttatgctcctcgacaaccccaatttgcaactacacacaaaattacacaaaacaataaactcttttgctcaaagcaactcatgaactctggtttcaggagcaagcagtggccgtggctcccataacattatagttatgaat

SEQ ID NO: 6440 - DNA, 1061 bp, Glycine max
  Soy_ogl_1281 Gm04:7635140..7636200 Cluster 28
gcaaaaaaaaattacatttagtaaaaaaaaactaattatgtaatcctaaaattgcttaattatcattattaagatatctacaatatctaataaactccgaaaaatatattgagttaaatgtcataaatggtcctgagtcgatgtgtacagttacaattttacatcacttgataaaaggaaatatgtaaatgaataatcaattaattgatattgataacattaatggcaacaggaagtacaattatagggctctgatccccgtactgtgaattttccttaatctaaacacgaaacatgatttatagttctctcccaaggtatttttctgagtaaaactatgagtgcagtaattgtcatgctggggtcaaattgccatcaactgatgtgtcttttgactaagaaacagaatctttggcaagggaattgtgacaaaaatttagagagtgtgtcaagatatgtgtctgatacatggatccttttcaaaggtgaccatgcttatgtttttaacttttaatttggtcaacttattcccacctttcatctgtacagtataagacaattaaaaactgtccattattacaagagtacaagaaatctatttcaaataggcataaagataaacaatctgcataaaaaaacgataatgatcttcaattcctttgcatatctcttgagaagatatcattaagaaatcatgacctgcactggaggtaggtcatcaaagatttgtttcacacgaaagattataagaaagagcccttgagagtatgagcattttgttccagagaaatatacctgaaaacagaaaatttagcacaacttaataaagcttttccttactcctgttaaagcctttaaaattagttgaatgaaatttggattgaaggacacacaaaattcactgagaacttcaaattgcctactcaacaggatgtgacctctatggcatcggttcaggctccattttgattttgctcattcattatgagcccgaattattactcagttaattcacttttccttgatccatcattgtctgaaattagatactgtttgagaca

SEQ ID NO: 6441 - DNA, 1346 bp, Glycine max
  Soy_ogl_2080 Gm06:45239426..45240771 Cluster 28
caaggatcctataattcttcatctattaaaggaatgacagctgtacaaattatctcgattgtaataatgcctaaattacagctaacataatatttaattgcttaatattagctaatagaatatttggcatatcttaaccgtgataatatgcatataagttatataactgaacgtttatagggaaaaaagagcttacataaattttgatgactcaattccggataaatcagcagatttattcaaagcatgtctccaggtttgcaccctggtcttatattttctttcatgctaagcaaatgcatttttgtaactccctgattgatgtcttacatctgtgggttctacatggtaaaaaactgggattacaatctgcccatgtttctctttgcattcaagtaaagtcacaagctcttctaaacaccaacgcgaaaaagcatagccttctgagaatatgatcaaggaaatgaatgatccttcaattgctccaacaagtgatggccatatttcatctcccctctagagtttatcatccataaaggcaattattttcttcctttaaaaagtgtcaaccaaatgtctaacaaatccgtcacggatatcctcgcccctgaagctaacaaaagcatcatactttacttgaggagtgttgttgtctaacttgggttttagcccaacaccctttagtttttgaaataaccgagagacaaattcaagtgaggaaggaggaggaagtcatatgacaaatacaataccagcttcttcaagattagcaagcttccaaattaagccttcatcttcatcaaattaagccttagttcttcttttctttgcccaaaaatgaataattgacagagatcagagtaaagctgtcattgacttcgaacagtatgtagcgaagtcagggtttgagtcaactcttgctcatgcaagttggaatgtcatcctgcctgtcacatgctatttaagaagcaatttcattgaaagtatcccaaatattatatagctaagtgatgcttttgggtgttagttttcaaagtcaactcttgcttttgtatgttggagagtaatcctgctagacctgcagattaagaatcaattttattgaaaatttcaatttgaaagtacccccaaagtcaactcttctaggttcacataagagttgcaggatcaaaattcttataataacctgcaggttcacatgaaggtttactcattaattttttctattgaagattttagtgtaaacacatttacaaagaattcaacatattttttttatcaagtaatagtattaatttctataacatcacttttcaacactagctagaaactattttcaacaaagt

SEQ ID NO: 6442 - DNA, 1000 bp, Glycine max
  Soy_ogl_4722 Gm14:6650001..6651000 Cluster 28
atttcacaaagttgaagatctaccagcaatgagtcctcactcagcaatatgattctggtaagtagtcaagtccatcgctcaacaataaagtctcagctctcagtgatagcattctagtgagttactgataagtctctattgttcagggaattaattacctattgtctagtctaccactcagcgatgacacattttcctattcaatataaagaatgcaatttagaatcttacaagttgttgcaatttcttggccacaaccactccaattcatgtattctcaaatcggtgcatgtatagaaaatgggaaaatgattatttcttcttttttggatgttgatcgtggtggagaagggaaactatacatgtattcagtgtttgtttgaatacgtgcataatcaattttcaaacaaaaaaccatggtgtccccgtgaattttgtgaagcaactatatgttgttgtggctccaccatgggattggccatgattttttttctaccgtgccgtcaccctaaacacacactcagtattctcaaatctaacggttgacaaccaagaataacttaacttccaacccatattggagtcgaacaatttaatttgatggcttattctattgtgtgtatatttaaaaaaaaaataggtttttttcttgatttgtttcacaacgatcaaactctcccaatttttttttatttataaaaaagatatcatcagttgtgtcaccaaattgaggagttggtatcaatttatgtctaattgctccacatacaattcttccaaccataatccaaattcatcttgtaatagatatgctacaaaatgaatagatttatttttcaaatgatttatatccttaagtatatctatttcaaatcaaaagatcctcatggtaacaaaaaatgtattgttatgagatatattaagattaagcttgggtgaaaagagagctgatattcccacctctgtttttgataagttcacccccaattttaatgttttg

SEQ ID NO: 6443 - DNA, 1100 bp, Glycine max
  Soy_ogl_2338 Gm07:14796901..14798000 Cluster 28
caatcttcttcctcctacagcaaacaacccaaaaaccaagcaaaaaaattgagacctaacatcgaaagcccctaaaacagaaaacgcgattcatatttttcattgtcgacaaagcaaaagaggctggttttctttcttcattgtcggcaaagtagaagagcttgggggattcgaatttgaatctgaagtcagaaccgcgattcggggattgtggacatcaactatgaatttgaaccagttgccgttggaatcaaataaggattcgagatttatacgtggttgaggggtggttgcaaccattattgatggcattgaaagaatagatctatgtgaaaatgagatggagggaaacggtgacaggatggaaaaaaacaaaacatttatcatcctcaaactgaaaactcgcagtatactgtaccgttaaaatcttccttttcatttcttacctttgcatgtgtggaagaggtcgatgatgacaccgatttgcagtgggcaccggcggtgagggtgatggaagtacagtgatgcttttttgttttaaatttttttatccttgtattgttttttttttttaaaaaaagggaccaggacatgcatgtaattcacttcaaaatatttaaagctgctagattagggggagtgaaagatatgtctgaaaaagaagaggatgtgtgtgtaattagtagaaattttaggaatgttgctgtaatttatttaaataaaattatttttaaaatattttttattatcatgaataaaaaagagtgggtaattttttgttgatcacaatctaaaatgaattgcagcaagtaatattataaaaataaatataaaaaaactgttattataacaatgaacataattaaatattttataaaataaaatttaaattacttacaaaacaaaattgtttactccaaacaaaaagtctagttattttttatcattaaattaaaattctagttatttattgttatgggaaagatgattgtcaatagtaaacataaaataattagattaacaaacaaatgaaatagtttcccttccaaaaagtatagtttcatcttactttgtaattaaaatacaaagaaaaatcatac

SEQ ID NO: 6444 - DNA, 1100 bp, Glycine max
  Soy_ogl_2591 Gm08:40801..41900 Cluster 28
acttcaagggtgcatgttaaaaagagtctaggtgcaaggaggctgagcctcactgtttacatttacatagttggtgggaagtatcaagtagaccccagaactatatacagagcgtcttattaggtcacatctaaacattacaggagagagatgatgaaagtgaaatgccaaaaaataaagcaagaatgacttttcaatccacccattactttctacatctcatggggattgggaaattggtgtattcttctttatgttcctagtctttggatagagcagatcataagtgatttagtagggaataaaacattcaattctgtttttccatttctcattaggtattagctcatgagttagaagcaatggttgtcagttaattcatataaaagagattagtctctaataatatatcacaaattaagatttaaatttcctgaaaaaaattatgtacacatttaatgtcatacaatatctcaagtagaagtatctttaaatatgtgaagaaaaataactaatttttttacatattgattttcttttatggaataaaaatatatttaagatttcttattggatacttaattaagttcctttttattagatcgatccattttagaatattttattctaaaatgatatttttaactgtgatttcatacttctttaagtgaaaaatcaattttttttccaatcactttggttaataacttttgatttatatatagacttcttgatgatattctgtccgtggtaagttcggttttttttttttttaggttccttttgaaatttggctctaacttatcggccacgcacggtgactgaaaagattctaatgtcaggcgaggcagagcacatcgttttcctttgttttcttatcttttgatctctgtctacttcatgaacactgtccacacactcaaaccctatgcccatagatttctgtgtttgaggtcagttctattggcccattggattggatcccatcaactttacctacttttcagccgagccgcgctagatagagccaagtacgtagccatacccaacatttctaagtccctcattgcttgtactcaacaacaacacaagcagttatg

SEQ ID NO: 6445 - DNA, 1089 bp, Glycine max
  Soy_ogl_4274 Gm13:26245101..26246189 Cluster 28
atatttattcgttttatttcatggtcagaactcagaattgaacagaggctaatttctccaacaacaggtccttaattaatgagttgtttgttagtgacggtcacttggatatggagcagtagtgaggaagtgacgtaaagtaattggaccttgcacagagatgcaaaccaaaagaagacagtcacagtaacttggaagaaagtttgttcttcagcacgttcggtagaggagaaaaaaaaaatgaattgaaaagaaatttttaaattaaagtataaaacgtgaatctcacattttattgtttatttatctcctttttcatcctttttggccgcaaaatgtaggcaacctaaatgaggcatagtggggactattaattggttttactgtcctttgcaaatttggtatccataaatttttaaatcgcagaagattcggtttctctattcaaatttcattcatcgtccttgtcaatgttttgaacttgtaattattccatttttttaatattatataatatattcaataattgatataaaaatagtacatatatattaatacaaaaaactgtattgcatattttacgaaataaaaagtttatcttaaggatgtgtgtgtgtgtaatgttatagtattgaaagtatagtaaaaagcattttaaaaacagtttagactagctagttctggttcacttgcataagttgtcgagttttggtcaattttagccggttcttagattgacatttcgctgcactaatttaattatgtaagttgttatagctatacaaattattaataaaaccaacttaatatttcatttgattaatatttttatttacttaatgatgacatcaaaatataataaaaaattaaaaaacatattttacaccatcactttgcaagacgaagagaataaatgcatctcctcagcaataagacgtaaaatgaccaacaattacagccagaaaagtttatccataaggatgtggaatgaggatgtgtattttcttttatttcctttttttttgggtcaaaataagggtgaggataacaacacaaaatagacaaaaagaacatgtaaggcccatgata

SEQ ID NO: 6446 - DNA, 1095 bp, Glycine max
  Soy_ogl_5414 Gm16:33875206..33876300 Cluster 28
ggggggggggggggatcctgcaatatgtttgtatccatagttttgtagagactaaaaacatgaataccatatatttttcaaggactaaaaagtaggaattaaaaactaaatttattggactagctacatgtttcaaatgaaactagctagaaccttgaatatttgtaagtcttatcaaatcatttaattaatttctcataacatttgtttttaattgataacataatcaactaattcaatatttcatgaaacattttggatagttaacttttagtaaaatttattagaaaaacgcaataaactaattcaatatttcatgagcacaataattggggttgtaaaggacgtgataattttttttaaggaaagggtgggattaaatttgccttgtgctttaatgattattgaactaatacacttaacataaaccattaaaaacttgaactactacaggattgaatcatgcaccctcagcgggtgacaatgagaaggaattaaggagaagagtacaacaatgagtagaatgagaaagaaatggatgttggaagattaagggtgtttatgttaaaaggtcgttctggttcagcttaacttaggtttaactcaattgagacaaaagatttgcttgtgattgccagtttgccatgtttcaaacaaattgcatgtagtcctacacacactaaatcacttgagcacctggtatggtctcgcgtatactctttaatgggattaattatctggttatacatcaagcttgttttttgcaagagcgaaaccagagtttacccacaaaaaaaatagagttgtttgcaacattgtgctatagtactatatattgtatcagattttaattggtctttttgaagttttatttttggtgggtacatagtgatgtaattcattgaaactataggctatatattttgggttgtgggtgctgttatacaggacagtaccatgatatgtaacttttggattggcttggtcacttctagtggctattctaatgctttgtttgaatgaaatgttttgccttttaaaaaaattattttgccttgctagaatcgtaaaataaaaaatgtctataaataaaga

SEQ ID NO: 6447 - DNA, 1200 bp, Glycine max
  Soy_ogl_5678 Gm17:13813101..13814300 Cluster 28
gcccatgagatacagcaaattaaattttaagtttctcaaggcaaccagcgacctcgattattgacacctgtctacatgcgatcaagatattgaattgacaaaatatatatgaaatatgacactccaatttttttaatttttaagataaaaagtgtgattgtttccgacgtaagcaatgttgttacctttttataattgattaaaggttacgttatgaatctgtcaatggagttaattgtctctcattaatttactataaaagatataattataaaaaaaaatcagaaaatgaaattctattctttattatacaaacacggtttcagttcttgttacggggattatcccaacattagatgtgttaagtccgacgtatataaaaccaccgacataggataaaaaacgcgaatattaagcgacacatgacaactaatttttctgtcaaagacctataacgatctataaatattgtaactatacgagaaattagataattctgattcattttacacatctctctcgccctcccttcttccctctcaaaactctctcccaattactattatgatcacgctctttacattaattctagtgattatattatagtagtgcttttttcgtatagaacacggctttagttctttaagattgtagtcttaactcatgtgtgagaatatttatttagcagaagaatttttctgtatttgattttcattatgtgtgtttaaaaattttttgggtcaaacaacagttacgacctaataaattgaagacatatgtgatctctaaggtgagaaaaaaattaaaagttgaattgaagtacaacataagtgaagctgtaataaatattgtaaaattatttataactagttttatatagtagatatatttgagtgatcacaagcaaagacactcggatccatgttcaatggctgctaaatgtaagtttcaacattcttgcattacatttcaatttagaatggccttccaccttccagattttgactcctagcatcgcaatcgctttacaggcaatattttagcctaaaatttgtttggcatgatccggaaattcaagttcattctttcgccagttatctaaataaaacaaacaaattaacaaattgcatgattttgtatactttaaatggaatttatctttagattattgttgttgtaaaaggaattaatctttaggtg

SEQ ID NO: 6448 - DNA, 1400 bp, Glycine max
  Soy_ogl_4264 Gm13:25661401..25662800 Cluster 28
tgtctgagtttcctttttataaaaactaagacaattttgttatattgactctcctttttctttattcactccctttttcaatttgttttctaaaaaatatactctcctatttacttagaaaaagagagtggataagcaaagaagagaagtgaatataatcagtacaaaaactaataacaaatatattttatggtagatctaaaacttgagttttagttacttcatccttgggtccagctaaagacatgtgttgaaccaagagctgatatgcgttcatggagttggttttacaaatcaatacaaataacaagcttcccaagctatgttaagaccatggtaaatgacaaacaattctgtatggaggtaggcagccactccacaatatccggagtaaccgcaaatggtattgagtttcaaccttagatatataattgttttcaatttaaaaaagaaaacttcgttgtctcttaaaaaaatctaaggtgaaaaattgtcgtgaccatgaaaaggattaaataaatttgcataagttatttttattttattttattagttttttgggggcattaattcgttttatgactttatcaactataatttgagaaaggagcaaaggtaacagcactaatttccacaaaaagaaaactggggtatcaatagtggtcattgacgttatcaggaagcaaggaatactgtacaggcccagctaaaggccaagacctcttgtcaaaatctttgatactatgccaataggctgaacatttttcttcctggtgtctgtgagcctacctgaatgtgcataaaatttgtatggtatgtttcattgagaagaaaaaatatgaataataatatttttattttgttaaaaaaaaaaagaggaaagatgttcttaaaaaaaaatcaattttcgttcagttcattttttctttaaaattttttactatccctaattttccttctcctgtggcaaatagaggggcattgagaagcagtcatgtcatgtgtatgacgtaggtagggcaatggaggagacaacccacgtgtaatgtaggattactaaacatcttggtttgcatcaccttgttattctccataatgtggatggtggcgcattaatctaccctctctatcttgttaaagaattcaaacgactaataatctcttgtattttcaacaatttattggttttttttttctttactttttaaggattttctatcattattattgaaaaatgtgttcaaatgttattgatataattttttttacataaaatgataaatgaaaagacatttacaatactatcggacaactgccagtagaaatccacctaaaggattattgcacaaatctaaatcatcagtttgacctagttatacctattcaactagtctataata

SEQ ID NO: 6449 - DNA, 1100 bp, Glycine max
  Soy_ogl_6404 Gm19:36692001..36693100 Cluster 28
atttgaggagtcatgatgcaggccattttgagatagaaaataaaaatttgaagtactatttcccaaagttgttaaacttggaaacggaaattttattgtttttatctgaaaagaagtagaatggtaagtgaatttttcttgagccaactccccatttccaagtcagaacaagaaggaaaaggagaatcatatcataatcaacttttagaaactgggtcattgatgttgtgggctgttttgaaaggcacgggatacttgcataaattttgcatttacacaatcttcatatactcttatatattaaacgtgtgaaacaattgatgtaagattgatttagtttaaccagtgacattaggtttgaatattagatatgcagttatgtaaatatttagaagagaaactttgttattcataataatcttatctgaatcacacagaattatcttgagtgaaaaatctagacaaaaaaatcttttactgaatggtgtccatagtaatcatacgcgactcaaacataattatctccagtaaaaaatacttttgttttaaacccaaaaaaatcttacagaatggcatagagtatatactatgcgctcaattatgtttctacaactcaactacttatgatgatgggtccataaattttacgttgtgggggcaaaatttctataaataattttgtagagacaaacttatgttatagattaaatttttataatttatttcatattatggggcaatttataactatatatattattagtaatttttttaaaactttgtggggataattgtccccgttgttatatgagtggatctgtctctgactacttacccttcctctttctttcctgtgatgcattgtttgggttgacatttgcctgtgtatatgtgtctttttggttatgtaacttaccggaaacactatttgattaatctaatggtctaaaatgaagaaaaatggtctaaaagtccccaaagaaaccaaatccaaagtcattgaatttgttcccctaccgaaatcaggttgatgccctctaaatagattttgtctggtaaaatttttaaaattaattcctcataaaccaatcccttcaaaa

SEQ ID NO: 6450 - DNA, 1170 bp, Glycine max
  Soy_ogl_4087 Gm12:34285523..34286692 Cluster 28
tgaaacgagaaaagggtcaccaataaggagtgaagaacgttagaggtattggaagcgtcggtgaataatgttatggagtatcaaacacaaaacaataaaaggaaaataacaaaggcacactctcaactcccaagtctcacctaccactagtcgcacacgcacacacacctttcaccatcataatttccttcctcactaaatcctctttttaatacaatattaaatttatgaatcttattctttcttatataatgtttatttttttttatttttatctgagttttacacgtgtactccaacgattctaaaatccaaaccaagaaataaccaatactaccaattttaatcatcccctcctatattagtacaacacattaattagccccacataaaaatgcataggcgaatttgtcttccatgtgatgtacagcctaggaagtgtagctgatctcttgatattagagcttctggcttctcaataacgatcaaaaattggtttatctttggttagctaaaaaactcatttcattaggaagaggatataggtataagaaatacctaccctgctgggctggtacaaatacaaatcaggatcacaacacctaactacttttggtgtaatgggtattgtgattatattcttcttatttagaatcaagttcttcaatgaattacgaatttgcgattgtgttcttcccatttacaattaagtaaatttaatatatttttttcatacaaaaatactatgagagaagctgccgtaacgtgacatacatgcatcgcttcatgacttaaaagaataataactcacctttcagaatagccccatttggaatacttcgtgaaatttccgtaactagttttgctgtgatttcttcaaataataataaataaaaaaacaaagagttctataacaatttcccaaaaaaaagagaattcatgcaattatatatgatgtcataatttattactcattatcatttttggggttgatgcgttcgtaaagacggcattaaaaaaatcatttcggaagggtgaattataaaaatgttcaattggttggtgcaaaggtaagaaacaaacaacgaccaacccacggaagacaagtcattgtgcacttcaagttttgacttgtgcttgctttagcagtcaatcttgaattgagaaatt

SEQ ID NO: 6451 - DNA, 1472 bp, Glycine max
  Soy_ogl_5995 Gm18:8452429..8453900 Cluster 28
atattttcttaaatcaaacagactttgagctttcaagttctaccaacataaagaatggactaacatgtatagaaggttcaacttctgtatctatcagctgtcttagggaagtcagtaataatgccattaaccttgactccaatgacaaatgaatttatctcaatggatggatctaagtacgtagtagtcccatgcttgagatacaaattcattgctgaaagtttctacataaactgggagcttaattaaatgattttagccttgccagagtgtttgtagagctaactagaaaggctgcagtttcaggaaaaacagatgcctttcctattaccacagaatcagcaaatgttttgatgtccttaattgctgaatcagcagcatcactaatattcttatcaaccttgtaaaccctttcaaatttggattttatctcatcccatgtcaagctgaatgtgtatatgccactgcgattttttatctcccggatagttgttgcacgatttttgaattttgtatcagcaactgttgtgctctctgaaagatatatcgagcttaagcaaaagggtattccatccttcgacatttgaaccagacagtcaagtacatctgccccatctgatttagctttcttatatgcaaggtcagtacaagcatgatagtctccacttgctccatattttgtgataaccaaaatgtccactatagcatgaaaaatatgaaagaagaaggaacagatcaataaatacaacttaaatattatgttccctcaagacatgctattaacttgattgacagcaaagaaatgtaataacatcagagagaaaataacttatacttgtgttttttggcatttttctccaggccatgtgtttgcaaaagatgtccaaaatatttactggattatgacatcattggattacgataaagaaaacattatatttaatgatacagtataatctgcttataatttgtgaaacgatcaatagtaatttgattaatgcataaagttacaagttagctacctattttcttctgcttgaaattgttttcagatgacacacaagatcttaagtattttttattttgcgatatttttgcttctggaatcttcttaagaagcatgtgagatatattgcaacatatcaccttggtataatagcctttatttcttctaataaagcataacttcttcactgcagttatggaaatttggtggggatatacagttccttaattgatattgcttgggcgggcagcatttgttttccctctctctactcttgccaattttacaaacacacgtgctagttctgacccagcatcaagtatcacattcaaacatcaggtttctaaacatattttatatgatattctcatactgtaaatgttagagttaattaagaaaatatctttaattatttatatgcttcttaagtttggtaaaccatccagataatcatttggtgggctgg

SEQ ID NO: 6452 - DNA, 1800 bp, Glycine max
  Soy_ogl_623 Gm02:43085301..43087100 Cluster 28
catcaatcctggaactatgaatatttcggctaaaagcaagcattgatttatccaagttaattttatgtctgaaaactttatcatatgtaagaagaatctcagtcaaatatgttgcctcctccaaaaaaagagcaggtgaaaatgatattgtcatcgacaaggaataaatgagagataagaggtgcctttggacacactttaagtccatgcaaggtccacatctctattgcccttgtgatcatcgtcgagaaaactttcgtacaaaggataaaaagatagggggaaagagagtccatttgccttaatcccctgtgagggtaaaaaatctctgttggtactccattcagaagcacttgaaaatattttgtccttacacatcccataataagatcaacccatgctggggggaagcccgtagacatgagcattttttccagaaaagcccactccaccctatcataggcttttgaaatgtccaatttcaaggccatacatcttttctttcaagcactcttcttcttcatgtaatgaaaacactcaaaggctacgagcgcattatttgtgatctgcctattaggaacaaaggcactttgtgtttcacaaacaatttcaggaagaattaattggagcctgtttgcaacagttttgccaccaatttaaagatcatgttgcataggctaatagggcaaaaaaagactagcatgattaggtctttttacctttggtatgaaagcaatcaaagtttggttaagagataacgagtccttcccattgctgagaacttgaaggaccaaatttgtgacatcttcacccatcacttgtcagaaacgttggtaaaataatgctagatagagtaccatcaatctcaggtgcatttgatgggtgcatttggtctagagcacacttgacctccttggttgtgaaagccttatccaaaactgaagataaatctggtcaaacacggccttagaccatattagttgcttgctcaatgtcaataggattcaaaaaggtaaaacggttagaaaaataggacgtgagaatcgaacctatattttcctcttcctcgaagcatactccctgatcattcttgatcctgtcaattgtattcctcttcctcctttgtcgagccatatgatagaagaattttgagtttttgtctccataatcaagccaagttgccctaggcctttgggctcacttcatttcatcatgttacagtaggcaacctatattcttttcttcctctataatatgtttgacttgagacagaacctttggatcattgtgtaaccaattcaactttttttaaaacttttttattatcttaggaaccttaccaaaagtatcctttccccactccactagttcctcccttacccaagccaaatttacttccatcgatccacccttatgccatatttatccaccactttagcacatccatcattttgaagccaagcttcttcaaaatgataagagtttttcaacccttttctttttacgtctggacttgtagtcaaattcaacaaggattggactgtgattagaccgatggagggttagattcgaaacccatcatttcagccaaacatgaatccaactatcattctacagatctctattcaaaagttcttttataagatgaggcatgtttctcctatttgaccatgtaaatcaatatccatcaaaaccaaggtctactaacctgcattgctctagtaccattctaaaccaagcaatgaggttgatatttgcctcatttcctccatttttatcatcagggcataagatctcttt

SEQ ID NO: 6453 - DNA, 1000 bp, Glycine max
  Soy_ogl_1577 Gm05:3464501..3465500 Cluster 28
tgctattctaaattagaaaattcttaactttaataataccctatttctctctctttccttctaagaatctgccattacagactccacagcggccaacactgcttcaatttatatttgtttgttggcttatttgttgtgcagaagacctcaatggggggtcacatattcatcaacatttatgttactttgacggttttgaactttgaaccactcccaaattgtgccatcagctaattcaccaactactggctgggtcacactttcaagttttctgtgttttaaacttggaattaatttttatattatgacgtactaatcttaacataaaatgtgtctgacatataagtgttaatagacttgaatctggtttacgcaagttgaaattcagacaaggtcagaatggaaaaccaaattaatggtgaaagcagaaaaacttcccctcactatatgtggccatagattccagtttttcaaccccaattttttgttttatattggttttgccaaaacaacactcccggactagatctgcggtactccaactctggcaacgatgaaagattcacattttctcaccaatcttagatctgaaaaaaaaaaaactcggacctcgaatgccgtcgatcgactccggtgatggccgcaccgtgctcctctctgtggtgggactcaggtcggagccaggtgttaagctgccggcggaggccggtgcgaaagtggactatcgagcccaaagtggcggtgtcgcgacaatggggtgaagtagtcgtgcggtggaagattcttgatggtggggtgggatggagcgaagaacataggaaaaaaattgtctatttgttatttttttacttattaaaaaattatttaatttcaatttccaccgtgccattaaaatattttaataatcaatctaagcactggtataagtgttccaccaatgaaacacttaattgctatttcaccgtagacaaaaccaaaaagaaaaagaataaaacaaagt

SEQ ID NO: 6454 - DNA, 1500 bp, Glycine max
  Soy_ogl_1638 Gm05:31300301..31301800 Cluster 28
aagcctctagggactttctcaatcatatccaattaatagaaactctagaaaagcctcgattctgctccaaatattcccaatgactggccaactgagataggttttgtgttgaagggccatctttcaatgcattagcagcataatgttttaaattcatcattctttcacctatccctttaccttcttccccttccatcaaacactttatcacttttgcaatttcctccttttccactatgtcattctcattaaattttagatgcagttttagcctctatcctactttgaggccatcaactaacatcactgcattcatcttttgctctgcaaagagtgaccatggtattagaggcactccctcttgcacactctccaaaatcaagttccaatcacagaggtaggcagcagttttaaagatgatgaggctcattggatcatgatctgcaaagagtgagcatggtattagaggcactccctcttgcacactctccaaaatcaagttccaaccacagaggtaggcggcagttttatagatgatgaggctcattggatcatgagaattagtttattatataattgtgattgtcttcccattcaacgtttcacctaacaatggtaggcgacagttgtataacttgattccttgcttctaaattagactgaccctgatatagatgagaaccacactacaaagacaaaaggttaagaaaattaagcacacaaaatacggctaggtataaatgtacaaatcaagatcaatatataaaactatctaagtaaaacaattttcctaattcccactcaaatattcccaatgactggccaattgagataggttttgtgttgaaagtagaaatgtacaaatcaagatcaagatataaaactatctaagtaaaacaattttcacaatgactagctaactgagataggttctatgttgaatgtttcaatgcattagaagcacaatcttttaaattcctcatcctttcacctatccctttaccttcttccccttccattaaacactctatcacttttgcaatttcctcattttccactatgtcattctcattaaattttagatgcagttttatcctctatcctactttgaggctatcaactaacatcactgcattcatattctgctctgcaaagagtggccaggctattttagaggcactccctcttgcacactctccaaaatcgagttccaaccacaatggctttggaaccctccaactcaattgtgactaaggacatgaacctgaggtgcccatgaagccacaaccaaacctttctcctttgtcctttccaaacacccacttggtaaaaatttcaaaggatcctcattttcagtctcaaggtaagcagcactagcaaaattacttggtgctctcaaatgtatactccttggggtaattgttctttgttaattggaggaagaaagatgaagtctatgaatgaaggaagggttttaaggtaagctttcgatgattctgg

SEQ ID NO: 6455 - DNA, 1200 bp, Glycine max
  Soy_ogl_3445 Gm10:38492601..38493800 Cluster 28
ccaaactaattaaggattcaataattcttagatcttctattagaagttagaaccacgatgcgaaagcgaaacagtgcagaccatgtgccaaagagataatatcccaattaagtttgctaactttgatcaaagtagttaacaaggccataatataccagtctaacaaatattcattcctttcacctgcttcagttaacgcaattatcaagaccagtatacatcacagttcacaaatcgcactattacggctgaaacaagttcgaatatactgaaattaaactaataaaaaattgaagttacatgcatatatttgaagttctgaacaactattgctactgtgtcttccattatattgggattttcgtttccaacgtttacttgcttacaaactcccctgtcatactcccattcctcataaaagtaattcggtttgattatatagaaagtctctgtaagggaaaattatgttttatcccctatatttttgtcccatgttgtcaagatttctatattttttatattgaagaatttggtcttaaaatattagaactaaaaaaacaatttttttcatgtattataacaactaatagcaaaacgtcaattatataaaatctcaagtagtgggtttatatatgtattgctatacctcaaggaagataattgtaatttgcacctatataaagagtagaagccttaatcctaagaactaatctacattagttacaacctactactgtctaaaccatgatgaattttgaagattagttgattattgatataggaactataaaaggaatagatagcttatcttatgattaaaaatcgaggagagtgaaacacatctctgactttttttttcaaacattagtattagattcggagaggcgacaaataatgttcacatttcaataacattgtaaaaatactgttgtaacaagtaacatgtcaatgacaaagcctagcatagcctctgggcctaattcatggcatcacccgttgtgcacttactcttgagccaaaacaagaaacatatctctcgtagaattgtctacaagatagttcaagacacatctggcaaggtcttcaattaattaccaaaccacaataatcagatacttaacatttaaagaaagagacttaacatgcaggcacaaactcaacacagtccacatcaagtggcaccagtgccaacttaaaaga

SEQ ID NO: 6456 - DNA, 1000 bp, Glycine max
  Soy_ogl_3464 Gm10:40081401..40082400 Cluster 28
gctacaatttttggacgattttttcattaattctgatggtttttctgtgtataagagcaaaatcggtaatgttaagtgttctcattgagttcttcactcgtccaatctattgatatcttccttctcagtattgtgagctccgtcaaaggtgtgagatataaaaaggaattccgatgataaagtaagagcccgagatgtatgtagtgagactaatatagaacttaccttctgttctgcaatcgtctagctaccttataataataccgatcaatgaataccgagtaacacccattatggacgtgtgtgcttggtgcatgttcggttggccaagacccactactcagtggatcccttacagtacattttgtaatggagacaaaaaaattgcaactaagcttatgcttaattttgaggaaagcgacagtgggagcgtatagagaataggccaaggagtttctatctgaatcgtgggagcattaattgagaggtttttaagaagcaaaaggtcaacgagagcataccagcaaactgtctctgcagatctttaatttgacagaaaataagtcaaaccacccccacatgatccaacactaccagcaccaggcttcggaactccacgaccaaagcacaaaccatacgtgtctcgcttaatgaggtgcatgccttgtattatatagtcatgtgattactcctttcaagaatttggtagaactcccagagaaacaaaaccactcagactcactaaccaacacaggttctagatgattaatttccttaagtctgtcataaaataattttatttaacaagacaaaacttatttcaataatttttatcgtctcatagattgatcacatgattttcaattacaagaataccttcctttctcaagaaaaaaaaaaaaaaaaaccccacgtagactcatgtcatacttaagaatttaacaacacagaaatcatggtccttcaatttcatttcccttaacttactattaagattttg

SEQ ID NO: 6457 - DNA, 1552 bp, Glycine max
  Soy_ogl_4271 Gm13:26060101..26061652 Cluster 28
aaaaaaaagcagcggattcagtagcacgggctgcaataagagctcgatgtgcaaatccagtgctacaaattcataggtgacagcttacatccttagtttttagtgggtgtgcatcaacatctgcaaatcaaatgactcttcttcaaaggaatccccattattcactgttgtgtgttcatgacacacatcgtaacactgcagtgcacgtttgcaatccataagttctaactaatgtatgactatctcctatgtagagaaactttcacttgtgtcttcaaaatttcacaatcactgaatcacatgattccaaagttacagcacaaccatccagtctgtgttaccaatcccattcatagcatcaaaagaagaacattcagtctcgaaaacagaaaacagaaaaaccttcaacttggcagaaccatcaggtgacctcttaaccaaggcatcaagatcctcctcaagataaccacaacctgaccataagtctcaaccatcttctacaccaaatcattcaaactcagctctctcctaacactaatgatctttgtttgccccccaacattccatcactaggcctaggcaatatcttcccaccaaaattgcacagaaactccaccttcctccccgccgccgccgccgcttccaccaccgtgatcaccaactattgcaacctctccgttgcccctaacaccaccaacaccataaccaaaaccatttgcatcattgaatgccttgtccaatccattacaccctaacaatttccccaaatttaaagcattcccagccacaacgcggttgctgaaactggaagcgtcgtagttaaacccaaacgtcgtcgccgccgcggggctcactgtggtatgcacaatggggcagacgcaccacattgcggaggccgacgacttgtagaaaagctccccaatggaattcggagtgggcggcgtgacggtggcaggagaaaatagtggctcctctgccaccaacgcggccacgtccaacggacgaagacccaacagagtggaattttgatcaaacgccatgacaatagtatgaatcgagatcggaaagaaaataaaaaaaatgaggaatgaatcgtgtcgtggaagattgatcaacgattaatgatttctgcattggggatggaattaaaaccctagtgaaattggaaaaaaagaggaaacgataatgaatcgcttctcagtcacattggctccaaaaaagacagggactctttcttggtaatttttatttattttgttttttctctctcaacgaccaaatgccaatggaatcaaatctgtttctttttatttattttataataattgttatttgaatgtttgaataatagtcctttttgattttgtgttggaagcacgcagaagggaaaaatgggcgcgtttttcatattttcccgggaaagcgataggtacaaaacagcacagcggaatcacaaaggagtcccaccctagccttccctccttcaccttcttttacattgttattagtttaattatgtgtgcattggatattaaattcatttataagagtc

SEQ ID NO: 6458 - DNA, 1100 bp, Glycine max
  Soy_ogl_6475 Gm19:40843201..40844300 Cluster 28
taaagatatttattataaaagttaataaataatttgtggaattacagagtaaaaatcttttattcggttggcatatatgctatttactcaattaatttttgttagacaaaagttatgctcatagaggccaatctaatgtaaaattttgagtggatatgacacttttttgtattattatcaacacagaatcactaggaggaattgtaaaaccttttgggtctttgttgcttgatcctattaattaagataaccaccattgtgccttttaaaaaaaaaaaaaagataaccacaattggataaacacattttttatcaatgaaaaaaaagtagtttcactaaattaaattcttttattttttgtttgagtttattatgtatggaggacactgtggtctttaaaaaaaaagtagtaaagatacggacacctattgaacaacaacaaaaaagaaacggacacgtacaagcataagcataactatcaatttcattacatatccaaatcctcactataaaaccatcccttacacttaagagtctaaaccctccctcactatataaggatcattttactctctcttttttccccgcacacacagcaacagcctcttctcgagaaactatactctttctttctacaagagcatcgttttcctcttaattctaaaatggataaaatggctgtaatctcaatctgtggtagcaagagcaaaatgatcctccgcggggtcccaagaatcagagttctcaagcttcccccatgctgtttcgacaacaaaagaacgcccggaaaaactcccaataagatcaataaaagaaaattatcacagacaacactatcgtccccaccaccgccgccaccgccactaataccaacaagatctaataactgccgcaacattggttcctccatcacagatcaactatagcgctgctggaagcggagtaaggcatatggaacagtatccacggggaaccgtggatgtactctcccagatgaaggcaagagctccggcatcgatgctagttccgagggaaaaccctccgattgaaacgcttgcagaatgggctgcctcacttagattcgaaaatggaatgtggat

SEQ ID NO: 6459 - DNA, 1200 bp, Glycine max
  Soy_ogl_265 Gm01:51447501..51448700 Cluster 28
gagaatctcatgggtgaaatggtccaaggtgtgctctccaaaaattaatggcgatcttggtgttaaagatgtagggatttttaatgagacactccttaccaaatggaagtggagttgttttcaccaacggaatgacatgtgggttaaaatcataaattccaaatatggaggatgggatgcacttggaggtgtgggaagccttcagaaccaatcaatttggtggagagatatcaaaatggtgcgtgacggtgatgatggtgataggtggtttgatgtacaggtgacgtggagccttggtgatgggatgagaacaaacttttggcatgacaattggatgggtgaagagccacactttgttagatttcctagaatatatgtcaattccttgtccgtggaggctaaagtgggtaacttgggatattgggaaggtggtgggtgggtctggaattttactaggaggcatagatggtttgagtgggaaatccaaagctttaaccaatctgagcctaagattaatttgtctcggctgaatcaacaaaggtgtgatgcatggtggtggaatgctgaggtgaatgagcttttttctgtaaaatcagcccacaagttactacataatagaaggtttgtcacttcaatggatcatgtattcaacaaaatgggggatatcataggctaccattgagactaaacctagttcgtagaaacatcatcccatcccatggttgttgcttctgccattgcatcgaatccactaaccatgcgttactctcatgtattattgctaatagaatgtggagaaagtgacttgacatcctgtcatcgccctcgcctttccctggggaggtataagttcactttttgttcatcccatcttgcatcaagtacaaagaggaattatggaggtggagaattgtttggggtgcaacaatctaggcaatttggaaccatcgaaatatatgcattttcaatggagtatgtatggattttgatctattatgggactccatattgttcacggcgtggagttggctggcttctacaaaattcttcgttttggtttaatcagtgggtaatgaatcctacactctgcttgttatttgatgtcatgttttctggatgaatgaaactctcatgggacgtgatgttgggtttgtggtagtgtgatattttatcgaagataaatatgcatggtggtgtatg

SEQ ID NO: 6460 - DNA, 1126 bp, Glycine max
  Soy_ogl_4233 Gm13:23742275..23743400 Cluster 28
ctttattgtttgaaggcttggtggggctacttcacaaaaagatctttctaaaggtttctggatgaccgaggaggttcaattttcgttgttgcagtatgtggatgattctatcatttttttgggaaggaacacatgataatttgtcggctacaaaggctattctaaggggctttgagttaatagctggactcaaagtcaatttctacaaaggctatgtgtttgggattaatgtagatcaacatttcttgttggtagcaacatagtttcttcattgcaagatagcacaattgcctttcaaatttttgggtcttccaattgggagcaatccaaggcgagtgtcattttgggatccggtaatggaggcttacaacaaacgtctctctatttggaaagctaagtctatgcctatagggagttgtcttatgatgattaattctgtgttaagtagcctccctctatattatttctccttcttcaaagccccaaagaaggttattcagactctcactgctattcagagaaggtttctgtgtcacggagcgttggaagccaataaaattagctggataagttggcataagatctgccttcctaaattccatggaggcttaagtattaaaaacctacaatggtttaattacaaccttttatctaagtggcagtggaggtttctttaggacaattcttccatttggtacaaactgttattgttcagctatgatactagtttttgggacattacttggtgtggggattagattgtataagatagctgaaaataaaaactccaaagtagctaaggtgttgtgtgtttcagatttgagtacttcttttagttggagttggagaaggctattatttgcttgggaagaggagacgctgcaggaattgatcatgcttctgcacctggcacgcatggatacttcctcaccagatctttggttctggaaaccgatagggggggctagcttttctgttgcttctgcttatcaacttctgttaaacttgtgttatgaaatttcttatgatgattctgttgagagttgggcaacaaacttctggaaatctttggttccttcaaagatacttgtttttgcatggagacttttgcaagatcatcttccta

SEQ ID NO: 6461 - DNA, 1261 bp, Glycine max
  Soy_ogl_2053 Gm06:42537340..42538600 Cluster 28
cttccaaatattggttacatatcttagtcttacatctacacttcccgtgcttccaaattcagcatgtcacatgtgccacagattcactcactaatatccttgtagttgatattctgtaactgcctttgccatcaaaccactacctttgcccaccataagataacaacctctttcttctctacacatgacaataactgctcaatcaggcaaattcacgagcacctgttgggctaattttatttttctttttgactaaatgaatcgatgtaaatgccatcacccccttacgcatcaagctactaaaattttcagattgatggagaactggatgaaatcccccaatggcatgtatagcagaatcttgttttagtgagggagcacaaagcactaccacatgaaatacagggtgaattgaatgtttaagattaagtttttttagttttacttagtaaaaaatgtactgccaaatgttattgatattaaaggagcagattgggtatttcgttcttctagtgtttttttatttttatgaaaacccatttatattgataatacttatcactgcatgtttcatgtttcgtagacattttagatcagcccaccaaaaaaacaaggtaagtccttaattattttaaactcgtatgagatggcatcatagataaaggttattatggtcatcatgtagtttaaaaaaaatcacagtaacatttggagacatgtgaaggaaaactgcttgttccatagttcctatcaaggaggtgtatgctgccactaaccatctgaatgtaatgaataccatttgtttgattcattatgcaaattaataagctttaggtgctaaataatatacaatgttttcatgataaaagcctctgttgaccatcggaacaagatttccaaagggtgcctctggaaatgcagtccttgcattcatgaacctgaactgtgagatgaagatcgaagatcaaagatcggatggttcatgtctcgaatacttaatttaaattagattggtggagataaaatataattggtctgatcttcatacaatggttgcgattagccaaatgcctgaatatgggaaaattccctgactgccgtgaatcccaatccctctaattaaataagctttagaatgcagcactgaactaaaaaatttcttgggtcatttatatacaatctagtaagtaatgcaccaaagttccaatttttgcatcaaaggacagagctgatagcacaaaaactaaatggcaaaaaaata

SEQ ID NO: 6462 - DNA, 1341 bp, Glycine max
  Soy_ogl_9 Gm06:418701..44108041 Cluster 28
ttttaatttaaatttaaaggatttttaatctagacgttctattttaattctctacctccaaattttaaattttatcataataaaatagcttacttactcatcacaaaagataggataagattcacaaaagacatgataaaaatcttttggtaatatagttagttatactatatatcctttatatcatcttttaacagcagataaaaatatttatcttttaacagctcaccgaggatttattaggattcaaattttatcataaaaacactcgatctagacacccctaggaatccgactatatatgctatatagaaacgaacgacgaacatttgtgcaaaagcatctctttcattcgtctgtttcacttcgtacagtagttccttttctgcatattgtgaggaaaacttgggttccattattgggaaacaagtttttggagaggagagtgaggagtttaagtgtgatcgagtctcatagtccttaaacccataaatagtttcatatttcaaagtctcactaaagaaatagctacttaattatatctatttcaagccatgtcggtgcatttcgtagactctctagcaatgtttgcaagaaggaatgccgaggaaaaatttaaactcggagacttaaaaggcgccataatttctgccaccatggccaaaaccctagaccccgatgtagttggcattgatgaaaccctcgttgcatacaaaatccaccttgcggcatcaaaaaatcgtgtcaacggtgcaacaaactggtacaaagttcttggcatctgtgaaggctttgaagacattgacagcatcaaaagacaacacaacaaattggtggagatggtgaacccaaccaagaaagcttcggtggcaacttggggtgctcttagactcatttacaaggcttcgagtaacctatgcgacccgaataaacgaaatgtggctcttttgcatcggcaagcacttgggtcttatttgggtcatgaagattttagaacaaagaagagatcgtgtggaatcaaagttaccaaaagggcatgtcctcggtgtagaaagtggtgcaagtatgaagttcctaaggtttcaagtggacacaaacatgaagaaaaccctaaagcaaaaacagttttgctaatcaggtgctccagttgcaggtgcaagtttgatccaatatctggcaagactccaaattcaaggttttcccgcggcaaataataagagagaaagatttttaattctaccggtttgcatccgtagataatcttgatgattttatatttgtacactgtataccttgattatttactgaaatgaaaatgtgttggaattaataattgtgagt

SEQ ID NO: 6463 - DNA, 1210 bp, Glycine max
  Soy_ogl_2367 Gm07:19277591..19278800 Cluster 28
catattttagttatctatttagttcctctccactttatctccctttactaaacaaaagctaaaacaaatgcatcaaatcttgatacatgtacaagtgtgacatcatataaataaatagaatagataaatagaaactagtgatatcccccaggtcctccaacggtgtaagttgttgcactagcaccctccacaagaacccacaagcatactagtgaggacaacataggtaacatccactgagacattcttgaacttataggtgagagggcggtaatagttgaaatacccttctgtcatggctaaacacccccattcatgaccttatctaaattactcttcaaccatggccatataatagtatgaactactgaaatcccctcgaccaatatgaaaccccttcagtcccctggacttaggccgaatatgcctcgacctaggtcaagcacatttaaaccccgaatagaaccccatcaagagatgtcataagtacatacccttcagctttagccaaatacccctcggcctaagccaaacacccgttggacaggtgtggacctcgaaggcatccaagaagctaactacagattaaggaaagtcacgtagcaataacatgtataatcaacatttaaacctcattagcaggtaaccctggattagcatcaccccaaaacctgaaggtaaggcccgtggaaggctcataatatatgtatataaagtatgagattctctggtaacatcattgttgattcttatttattactctcgtttacaacttttgggacagagctctaacttgagcatcggagttcctttgtaggtacccatccccaccgcatcggaggagttcagagttggaaacgaaggcagagtcgcaccagagaagagacaattacctcggtaccatcgtgcgagtacatttctcatagtgcaaaccttgttggccataattaacaagtagtgagttttggtcgtattggcttgctagcaaagacaaatctagtagggagcaagcggggcccatctttttcaacttcacatctagcaaaaaattataccaagcagtccatcaattccaatagcatgtgaaacatataattatattctcaccatctatttttatgtttttttatcataggatcaccttttccagtttttaatggaggtagacattgtctacacctttatattaaatttaagtattccattttaa

SEQ ID NO: 6464 - DNA, 1500 bp, Glycine max
  Soy_ogl_2816 Gm08:37348901..37350400 Cluster 28
ggccatcaatatcagaattcagcagcaagctaggaattcaaatggagcatgtttaagttagtatatcttcattgttagaacaaggctgaggcactaaaatgctcaacctgaacacagccagaatagttatatagctcaacctaaaaggctagcatgacctgtttataagttaggttaacctccatcgtgagacaacaaatctatataagctcaatccaaacccatgtattatagattctgctctatatcacaatccctgcttctttttttccttacccttctgaataggataattgcttgatatcccaaaagctgttaagccttgattgatacacaattagacattaagtagagttgatcccacccctgaccaccatgaataaatttggtacaaccagagctgggtaggcttttacccagcagtacacttcaaatctatggacatagaggctagtcaccactatggttttgaaaataaatagcttgagaattcccaactagctgtttgaactccaaagtagggtatgcgttcatttaaagaaggcttaaactataacaaccaaagtggaataatatggtccaaaacagattcaatcaagcacctaaaaacaaatttcctgataatttcactatatttatctttacacaaacgacatattaaataaaaaaaggaagactacaacatcattattccactaattctccattaagtttgtcctctctcaaaggttagctctcttctttctctggatttgggcagagttttcggtaggagttagaatcagtttgtggaatgttcgaatgatatcaatggcaggatagatgccgtagagtttgttgactagcaataccatctgtgagctttacattttttatgctaggtggggtgttcctttggaaaatatttaaggaggattttagaagtgtggattttgggaatattgactcaggttagttgactcttcaatttgatgatattgcaatcaatgtgttattgcttgggaaatgtctaccttacgtgaagatgtaagtttagcatttaactctcaaaagtgtagggatagcaattggatctgtttatcccataactttccagttcatccataaataaatccaaccaaactatccaattataaaaaataaaaaataatggattggatagattgagtcaataatattattggatggttaatgaaccatccaacatatttcttaaaccattggatcattcggagcaactccaatgggtgtggagaaccgagattgcttcatcctcaaaccacctggaataactcaaatgggtccgtagtccagtgagccaaccttgcttcattggtttacaacttcaaaatccatgaaataaaattaaaataatatattgaatgaaaaaaataaaacataggttgttagagctattgatcaaagtgaagcgtggaaccttagcagaaaaatcacttatatatctagaaaagaaagaggaagctttgtgaggaaaaacac

SEQ ID NO: 6465 - DNA, 1300 bp, Glycine max
  Soy_ogl_4032 Gm12:9719801..9721100 Cluster 28
tggaatcatgagactgggattagacagtgaaattttttaagccccctactccatgaaatattaataccaatgtaaatagcccataggtcggcatgcaatatgggtacaaaaaacaaataaaacagaaccattgtggtctccaaagacactatcagtagttacttggcttgaattaagcttgactgaaccatcacagttcagtttatactttatactgaccaacaccaagcggatttcaacgaatggaggggaaaattgttgggagttggacacctttttaaaactagctaagtgatgaaaactagtttcaatggcatccacttgacaaatgacacactctactactgcccatatatgaatatccagctgcttgaaaatccatccactcctagcttgctaaatgagatccaatgtaaccacaaagagcaaattccacttcctgccttttacaataacctttgatgtaaaattttggacaagccattgatcgaaatccatgttataaaaatcatcacgcatgttgatatccaaaagctttctccaaagatcatcaattaagggacaaaacttgaaaatatgatcatagctttcgatggctgcattacaaataggacacgaatcatcttaggtcaagtgtctaattctccttgcttcaatagtgagtaaagcatttgaagcaatcttccataggaaaaacctcaatctttcgagacctttccactgccaaataaatttaaacataggatgaggcacaactagcaatgaatttaacaagcttttattcacaccaaccatggtaaatttcccacaaacatcaccattccacaccaacaagtcagaaccaggcaaaatcaggcttaactgatgaacaccccaatttctagtacaattaacatattggctaaccaacctgatgctctcgtgatttgctggaatattattcaaaacagttttgacaacactcctttatgaggaacctaggaataattccagaaatctatagattgcccatctctgatacgccaataagagttattctgaacatgaggccaattatggcagataccctaccacaaatttgagcctagtttttgcacattaatcttaaggataggatcatccccacacttgtttttttctctaataatccgaacccaaaacacatcttttctatcatatagagtccaacttgttctcatcataaaagcagaattgactttccttgactgtcttaaacccaaaccaccagaaatctttggaaaacaaagtttagcccaagccactatacagactttacgat

SEQ ID NO: 6466 - DNA, 1075 bp, Glycine max
  Soy_ogl_4062 Gm12:24395915..24396989 Cluster 28
atgccaataataaagatggtgtgtaggtataaaaaatctttaatcaaccaaaccctacacccatctcttttctccttgcattgcaccaaacaccagcactgccaccaaaaccaccatcacaccattgtggtgccacccaattgatgctgccaacctcacaaccgcatcaccaacctcgacgcaccataaccaaaccaaaaccctgatggccactattgagaacataggttgagttgtgcctgcgagtttgggttgtgtccatagtgtgtcaagttcaaaaaaaaggacacagaaaatgcgtctgcaccacgtttgtcgcatgttcgatttatgtccatgttggaaacatgtttgacacctcgaagcgacattcaaaagtcgtgtttatgcttcctagatcctatacagagacgtatgagtgaaagaataagagagataaaaaaagtgataaacatgagaaccgatagagaaaattatattcacatttcataaaatgttgtgagattgaataaactcttaattacttaattcttaatgtttacagcaacctctgttaattacaaggaggcatgtaatgttttcaaataattaagggagttaatatgcatgagataagaagttttagtttaatatttttcaattaaaagattggtatatgggaaaaaatagatgattttgtgtaatttcacaaaatctcatagagtgtcccagcgtaatttaatggcaacctctattacaaggaggcatgtaatattttcaaatagttaagggagttaatatgcataagatattaagttttagtttaattatgttcaattaaaaagattggtatagggaaaaataaatgattctttgtaatttcacaaaatctcaaagtgtccccatgtaacttaatttactccaagtgatatgtgaaaaagaagaaaaagatatgaagcaaatatggggtggaattaagagaaagtaaatgtaagttgatatatattataatattttaggattgaactcctctaaggtgcaatttacaatttagaagtgtgcacatttaaactattcataataataaattattaga

SEQ ID NO: 6467 - DNA, 1300 bp, Glycine max
  Soy_ogl_4167 Gm13:12556001..12557300 Cluster 28
aactcgtcatttagacactcacatgatgagtacttgacttttcatatacaaaagaaaattattactattacacgtattgtgaagagagatgcatatataattcaatttgatgtgcatgttatatgatgtcccccacatacactgtgaacatggtgttgtttttcctttggtatgggagacgcccatgtcaagcctgtctgtcattcatatgcatgcgcatcattgtaggacgtgttaagaattacatgcctaatgtcgtttgtttttacgataagtagaacgacatgttgattgccggtatgttggatagtctcttacatgataacaagttttaaagcacacacgaatggaaactaaaaaatagtctccatatatagttgcaaaatcgtattggagcaaaggcatccagcccactaacattggtgctatatgaagaatatacgaactcccttcagtgttgtcaaaatctcaacagccaaagtttcatacatcttcaacactaagccaaagggtctccaatgacccaagatggatatgagcctaataaggcagaggtaaggttagcagaaaagaaagcaatccacatagcccaatctgactccattactataataatatcatattattagcttatcggatccgagtagaccaatcagtttctcatactaaatcattacaaaacccaacatgaggccccattagatcgaaaaatgcatttggctgagcatagactgatagacgctttcagctaatcatagactggtagatgcattaagctaagcatagatacatagacgctttcggctaagcatagatcgatagacgcatttggataatcatagaccgatagtgcattcggctaattatagactaatagacgcttttgactaattatagaccgatagactcattcggctaagcatagatcgatagacacattagactaagcatagaccgatagacactttcggctaagcatagatcgatagacgcatttggctaagcatagaccgatagcgcattcaactaaaactagaccgaagataactaagtcatttggctaaacatagaccgaagagacgaagttattcaactaaacatagaccgatacatgcattcggctaatcataaattgatagacacatttggctaatcataatccgataggcgaactcagctaaacacaggccgtagaaacaaagtcacttggctaaacgcaaaccaaagatgactaagttatttggataaaaaatagaccaaagaaactaagttattcggctaaaacaagattagactaagt

SEQ ID NO: 6468 - DNA, 1400 bp, Glycine max
  Soy_ogl_5117 Gm15:43315701..43317100 Cluster 28
ggataaatgcattttttataccaaggtggaagatttccttcgttgtacatagaagtcaacaatatataaatgcatattttaatgaaggtggtacactccgttccacggacatgtcaacaacctatacataccacgtcaatatttgtttccagttttatacaaggtgagatacgataagtattcaattttatcttttcagattttcattgtgggtgcaaggaatcttcttttcattcatcattttataattagtcaatatagcacgtagtttcgatgttgacttgtagtattggaggatggtcatttcattacctactatccatataataaaatgtaaaattgtcagattatatcaacttccgtgcgcaatgttaattagcaacatgaaagcaagtggagagtttcttgtatttaaaacatgagtggtgctaccactatttacatcatttgacattttttttctaacctactttctctaataccactattaataaattggagagaatgaattagaaagaatatatcatcgcgagagaataagagatgttgctgctgccattttcacaaggtcgtcagcaaccaagttggacttgtctgaatttttagatcctatggtagtagatgacttgtacatttacttcaatcctataagttattaagtatttatgtcacatttgataaatggtttaaatagttgattatttaagaaaaatatattgtatgaaaacatatgatataaacattaattaataagtttttttgataaaaaaaaataagagagaaaactttacctttgaagttgtctcgttacatataatcgggctcaagaggacactttgcataggccttaaggcatacaatatgagttgatctttctaaacacacctcccagttttactagtacacctcctttcacttattaattttccaactatatcctttccttttcttttttcagaagttagtgcacccccttctctgttccatgtattctctctttcattctgaattatcccattgaattgttcttgattccatctatgtgttctctctgacgtgggtttcattgtcgatgatgaatgatcacacatatgctgttgtcatcgccatcattgcccgttccattctaaaatgcttcacaaaaaaattcttgttgcttcagttccagcactccactaccacaaaccttatatatttcttgatgtcgccttcaaagacaatcacaggaaaataactaaatagaatggcagtgaagcctttagagatcacacacttttgctttggcattgacctttcgctggccgtagatgtcaatgccgtgaaaccttccaaaacaatcctcgcagatgttccattatttgcatggttgccaacgagcttgtttcaacatgttgttgtcc

SEQ ID NO: 6469 - DNA, 1000 bp, Glycine max
  Soy_ogl_6127 Gm18:51442001..51443000 Cluster 28
aatgagaacccgtgatgtgcaactgaaagcaaatggaaggaggttgcattgtgcatggatttaaggtagaacctgaattgagcaaatcactgaagagtgaattaaagagccaagccaacacaacacacacatagagggaataaagaaagaaagaaaaaaagataggtagcagcagcatagcaaatttgtggttgaattagaagtgtgtggacccatcatatgtgaatggcatggatcagagtatggcaggggtgggtaagttttggtttggtggtgtttgtaacgtaagaaagagcaaagggttgcagtgagtgtgttttgttttgcgacacaaacgaagtgaatagacagaaatacagttgctcttgcgtggcccgggtttttctcgtgacatagcggcgactctcggaaacctcatgccagtcccctcatcaattaataatatttttctttggggcatttcacaaatcctccaaattaggtcactttatggtaaagtgagtttttcaaatttttggtgtaagttttttataagtaaaaaccagttttagttaaattttaacataattatgaataaaattaataaatttgtgatgtaaattactagtcatacgtgataattacgcgataaaataatatggctggttgaagacatttattttgtgatcctaagatgttagtacaatttttttgatattttcaaaacaaatgttttaaatcttgaaaatttgaaaataaatatttttttatagaaaatgaaaagtattaaagttaaagaatattccttataactccaaattgagagtcatgatggttgaatcatatggttgtggtagtgtcttggttagctagccttagtggcatgtgtgttaagacttaggtcttagagcccaaacacatggttggatccgagacacatgctagattggatttatctccactttaagaaaattaagaataagaaatttaaagaaaactgtgatttgtgcatgttgcttgt

SEQ ID NO: 6470 - DNA, 1193 bp, Glycine max
  Soy_ogl_448 Gm02:8853808..8855000 Cluster 28
gagacatcaaatgagccagtgtggtctaaataagccaaaaaatcaacgcacttgttagcctctatgtagatatgggccaacgaaactctccagccagtgcaatttaaaagctttgatatcttagcaataaacggaaaaagttgcttcacatccgacgtagcctttgaaataatagaaacaactgccttagaatccatctcaaaatcaacattttgcacttgaagatctctagctatttttatcccatgtttcaaagcccaaagttctgcacacaaggagttgtagtagcctaatttaacgtggaaggtcgaaataggaacacccatagaattacttattaatcctccacaagcagcttggaaggaatgggcataaaaagactcgttgtcgttgatattcactttacaataaccatcacgtggaggtttccaggcaataggaacctctctatcttaggagcaacatggagatatctaagcggggagtgagcagctttcttaataagtgacacatgtgctaaggtttgctgctcaagactagtatgtaaattagattggttcttaaaaaccagactgtttctatcataccagaggttgagtatagttataccaaagaaagaagcctaggttcccgtcggagcttcaagtccttcgttgtaaggttaaagtggatcctaggctaaagaagcgagcccaatgatcatcatcaatccgtctagaccaaaatcctctaagctcatcacagtcccgaagagaatgcataatggattcatgttgcatggaacaccttgggcaagtatcatcatctgtcatgggtcttctttttctttcactatttaccagcaagctaattttgtaatagcttccacataaagacccttcctcgctgaggaccttcctaatcccaaatatgtggaaaagtgtctgtcattcccaatgaagattcagaggaattgttaggatacttgtaggcttccttaaggccatttggggagctcttccaaaccggaatatcttgcccatttgcaaaaggagggtggatcacagcaattttagcgcaaacttcagggggcagaagaatgttcaagaggttccaattccagctatcatccacagcataagtcgagacaggcaaattgagcttctaaggtggaatcccatcagtcatgcagtcaacgagtttaggtactccat

SEQ ID NO: 6471 - DNA, 1200 bp, Glycine max
  Soy_ogl_5729 Gm17:36142401..36143600 Cluster 28
gacattgttggtgttgtcttggatggttaaacgccttcatgatgtcagcaaaaaaagattggatttgactaacaatctgccaaaggtcccatagctgatcatgaaaaatagttgcattcctagatttccacaaaatccaaatggtgattgcaaaaagaataccatttggtcctttaagattgttgaccagccaatcaaaaacattagatgtatagaaatttgagggcttgtctagcttcaagtgttgccaaacttgggttgaatgatcacagtcacgaagaagatggtaaatggtctcatgtgcgttgccacacctattacaaaaagcatgaatagacatatgtctatagacacgaaacacgttagtagggaggctaccatgcaaggtaagccataaaaggtgtataatattctgcggtaattttaatttcgagacccaagtccagttcactcaatgaggaaaaggcaatggactcttggaaataagccaatgaaagacgaatttagaggaatgaacaccattagcaaacggtccccaaattaccacatcatcaacaatgacatgacttttgagcccctctttcacctcttcgagtagaaccatagcaagcatataaaaatgccaagtaccaccatggaaaatatcacataatcgtagagtggtgtcttagatattaacaaaagggaccaagtggcaaaaataataatcttgtaaccatttgtcataccaaatagatatttctctctttccaattcaaacttgaaaccccattctgaggttatcaatagctttaacaattgagttccaagtataagaagctcctttgataatagatgcatgaaggatggcaccttgcctcaagtatttgacttctaggatttgcacccactgtttatgtctcgcatgcagcatatcccaagcatgttttctcaaaagagagatgttgatgtgtctagcagggcgtatgcccaaacaaccactagatgtaggaagagtgatggttttccaatccaccccatggcaatgattatttcccaaatgaactggcggatagtagagtcaatcttgtaacaaacaccttcaagtatccgtaaattttgcatagtataaatgggcataaaagtcaaaatattgatttagctaatgtaactctaccaactctatttagaagcttcacattccaacctactaatctcaaa

SEQ ID NO: 6472 - DNA, 1000 bp, Glycine max
  Soy_ogl_6064 Gm18:18573801..185300 Cluster 28
ttacaaaattcaccttgagtttgataagttggaaaaagaaactctacatctactgattgaaaatccttttgaagagttcataaaatgatcaatcactgatttgcaatccatctcgaaagtgacattacgaatgctgagttgttgaacccacagaatagcttgatgaagagcccaaacctcagcttcttttggagcagggatgccagttgcagttatcatcttcgctgtaagaaaattaccattggagtctctcaaacagaaaccaacacaaaaggagttgctttccttgaagatagctgcatccaaattacattttatgtgtccttaatggggcgggttccatggaatgaaagtgttttcagtagagggagtatgtggcttcgcattgatctgcctccattgctcataattctgcaactcgagagagagagctactattggatggatggttttatcttcccaaagtctcatgtttcgtgaagtccaaatgcacaagaccagacttatttttgcacgctagtttggatgagattcctgcgaaatattgaataagaatggtttaaagctatcagctgagtcccaattttgttctatgatatgccatatatttgcttcacgccaaatcctttttgcatgatcacatgaggaaaaaaaatgccacgcgttctctatatttgtctcacagcaaacacattcaagagagtttggcttgaagattgtgttgagttgggaggcatccacacaatagtctccaaagaaaattcttaattttgtgtggggcaccaagcagccacaagacgggccaatttccttcactcttcaagttgtgtttcaagcatgttctccactgtattatgatatgcgctcttgactgaatactcttcattttatgtgaatctccagatcaatttgtcgtgctccattgttttgagaagagggatagatagaatatgttctgcatcagttggattaaaaatttcctccactagaatcttcttcc

SEQ ID NO: 6473 - DNA, 1000 bp, Glycine max
  Soy_ogl_2526 Gm08:6216401..6217400 Cluster 28
aactctcaccaaatataattataattaggcagggatcctcttagcaggtgtttgggaaaagactaattataaagagtaattgtttctttaagggattgggtaatatttctatataagcattttagtaagttacatttttatacaggtttttttaaaaaataaaaattataagttattcaatattttccataaaaataaatagaaacacattaataaatttattttaaaaaatatattttaccaaacaacatcttaaatgcatttttttaaaaaatcaaacttttagcttactaaaataatatttcttctaaaagtcaagtgagaggttcaagacgtttttaaaattgaggatacggatccacactacccttaggtatagcaaaggttcctagccataattcatacaatacaactttcccccaaaatgcacagagcataatgatttcaaataattcacccttttcctatacgacacagctactaattaagactatcaaattaaaaaaatggtaggtaccaaatgcaaaaacagatacaagaaacctgcgaaaatctccatttatgtataattatctaccaaaagatcaagggtaccttcacataaataacttttttgaggcataaatattgtcccatacactgtaacggattcatttgccaatctaactaagaaccaaggacttccaatttaaaagatgatccaagaccatgagcaaaatttaatgtctggcatatacaagggatgtgaatgtttctttaatttccttgaaaataatgtcatcctgtacgtgggtccaaaggaaccaaactaccatccaaataattttaacttgtttactttgagtccgtggagctgaatgaagtgatgattgcaattttcaagaacatcatgccccatccagcatagcaatagggccaagtcaaagaagagtaccaacacgaggctggttctttacaagagttgccatagcacagttcaaaaagtagtgatggtcccaaa

SEQ ID NO: 6474 - DNA, 1000 bp, Glycine max
  Soy_ogl_6405 Gm19:36714701..36715700 Cluster 28
gtcatccctttgaaaagagccaataacaatagaaatggagcaaatagcaactcccaacttatcacgaggactagttgggttcgttgaggtctaagctttgaagatgtttgatagggttagggagtctgggtgtaggcccacagtgaagatttataaccacttccttgctgcttttgcttggtggaaataggttttacattatttgtggtccttaaactaaaaaaattgtaacggctccactgtagaattccttgtgctttattagtcgtataaattgttttgcctaataatataaaaatgtttatctcaaccaaacaaaatgaaaagaaaaaactagcatggagactctgaagttgataatttggtgcctgtgttaggccacaatagtcttgtatggcaaacagtcctcatctttgatttcattagggcttatttgtgggagtgttcaacaacaagaatctcctggatatgccctaaacagcgaccccaatgacaacagcgataatcaaatgtgtgcagtggacacaacattttcgccgtatatatattggcacattattcttccatggcgcaattgaaatccatcatgttcaccgtttattactacattcctccattctggcaattgcatttcgctcacatgattgtttggtgcattcctacgttcggacaatgtcgtcgtcgtttcagccgcaccttgtaacgctacattgcgtgcaatggatcgacagatttcacaaattctgtttcatttttatcaaacaaaaaaagaagaaaaattaatgaaacagtaattgagttctatgagaaatttgtacacgtgagtacatgtaaaccgattctaagattttgtttattcttaagaattgaactcatgtatcacagagtttatgataattcgcgcataatactcaattaaatctctttaataaggcacatacttgtcaggcctggtgctgaaccatttctcggcacagtgtttgcgggcaaaagccaagtc

SEQ ID NO: 6475 - DNA, 1600 bp, Glycine max
  Soy_ogl_121 Gm01:38656501..38658100 Cluster 28
ataattatccaactcgaatagcagttgttggactctaagtttcagttcaagcttaacaatcagtgtcatactattgatcaaaacaaagcaggtataaatatgcaatactagactcaaaatatgcaacaaacactagacctaaatcagtgtcacagaaattggaagaaaatattttatccaagcacaaacttcaagccttattccatgtattggggggaagttatggctggccatatgggtagaggtgtcatagaggagcaggtatggaggaagggaccttggactgctgaagaggacaggttgcttgttgagtatgtcaggttgcatggtgaaggcagatggaactctgttgctaggcttgcaagtaagaaacaccaaacttttttcactgttttgtttcttaatatatatgattggattttcacatttataagtgacaatatagcaaaaaaacaactgaaattgttttcaacttctactgttcatgttggctacattcatgttcaccgaaagctcttcattttgaaaattatactattgtctggtagaaattatgatatgatctatgtatctatagttttagtcaatctctacgtgatacgtagttgagtttttcaattcacaataaagactagataaaactcaatatgtatcatggctgaaaccattaatctcttggtgctttgtaattttaatctctggtaccactggtattggtttacttattaataaaatatatatatattttcagccttccaaaaaaaaaggatgagagttggagaaattctgcacttgtcactgctatggtgcaatctgtgattcgcaatacaaatttattctcaatccactctccaagtaactcttcctcccacataaataacagtcttttccaccttcaatatcatctcacacctctatcccaccagctccctgtatcagccacctaatgacgaatttgtctaattctctgtgaggtaggttacaagttaattagtcaattaataagtttttttttcttctcttctcttaatatttgatgcataatcataacaaaaagacatcaactattcaagtacaatctcgattgacgtatgtacgaatgatctttgtggggtggttgggggcaggaaacaaggatagatgggtggaccattaaatcattgctaaatatctatgcataaataaccagttcacttggcacctttgtggtcacaagctcacagagaaaaaacactcattccaatatagaaaatcttgaatcatggtttcattaggtgagactcagattactcctaattgggtattgattctctcccctacaatgagtctcatacaatgcaatacagaacagtcaaaaccagccatagaaaaagtagaatccaatccagcaatacaaccatactgtaatgtgcttttgaagtgcagcattatcataaaaacatatgaacattgcttttattattacgaattgcataccataattttactgttatgcaggcgttcaacaacaatgagtgcaaacggataccataattttcagattcagaagaaacgcacctttgtgtgcttagtttgagggtgtgaccttcttctacttagt

SEQ ID NO: 6476 - DNA, 1018 bp, Glycine max
  Soy_ogl_541 Gm02:14200027..14201044 Cluster 28
gtctgtacagatcctgttatgcagagaaatgtaaaggcagaaatggtgtctggcttatctcttcaatcagtttttcttaggtaatttcaaataggacttctatcaaggaaccggaagccattttgtattttgtaacaaataaattgacaaatatatgtagtttataaattagtatatataaaggacaaggatataaataccacccaattaagttttagaaactatcacagcatatactatgttgctcatttatgaaataactagcgtgggatctgtgctaatgcacgctttaaaagaaataagaaagtgatcgagagagtgattgactgagaaagagaaagtaatagtgtaaaaaaaatactcagttttgtgtccgggcaacacgtgtaccagttgactggacacacacagatatatatatattatagatgagataagttagtttacctcccatgcatgcacaaagtttggaaaatccgtgagagatggtggacgcaaccaaaaatgtccctgattatactgaggcatcgatgcaagtataccttgtggattgatcccagtcatttgttgcggaaggtaccttggaaattgttggtgactgctgctactactactagcatgaggaagcacagggaagcttggtgatgaacatgattgaaaccttggaaattgttggtgactactgctgctactactagcatggggaagcacagggaagctaggtggtgatgaacatgattgaaaccttggaaattgttggtgactactgctgctactactagcatgaggaagcacagggaagcttggtggtgatgaacatgattgaaaccttggaaattgttggtgactactgctgctactactagcatgaggaagcacagggaagcttggtggtgatgaacatgattgaaaatgagtgagtgtgtttcctgttgtattaggaaacatgaagttaccaaatgtagcaccgactggtagaggattttgtgggttagttgctaatctaactgatgtgttc

SEQ ID NO: 6477 - DNA, 1506 bp, Glycine max
  Soy_ogl_2436 Gm07:39202795..39204300 Cluster 28
acgaccacgaccacgacctctacctctacctctgccgtacagaagctgctgcttctccattttgtttggccgctgctcatcatgaatgtcatcatctgaaggcaacaatgactttcctgggttgtttgctccagtctctaacttaggaggccttcctctgggacgttttggaggcttctgctccgaacccccggacatagggtcctcatctaggtcccctttaggacttccttgattgtaatgctggggctggccatcatgatcattctccaaagttgatgaagcttttcttttggacactgtacccaaatcaatatctgaagaaacttgctgttgcaactgtgttgaaggaaattctaatcctgtagatactacgcactttggagagccttctgaagtaggaaccaccagttgcttcccaatatcatgtgttggattaacagtagaattaggtgctgctggctgggatgaagaacctgtttctttcttgtttaaatgagaagagcactccggatcatcagcttgatcatgtggatgcatcttcttattgatgtggcgtgcagttctatgtagctcaagaccccttccatgaattttcttttcatttggctcttgctgaatggcagtagcatcacctgagggcagcaatgtctcctcttgatggtctgcaatttgcttacacttatgaggcgtcctctctctggatggatgatcagaatgcccggtcatcgggttctcatcttgcttgcattcttcaacgttcaaagataatgaacctgacattttggaagctgcatccacaccactttctgaaggttcattacatggcatttgcagttgcaatggtgcaggcaataaggggtttgcagctgctggtatgcacttcaacgctgttggctgggaggaacaagttgttttcaaatgcagcctcgaatcctgttttaacaacagcccttagacattacattacatatatatctacagtcaaatagaagggagaaggggtttccaattacatttacatttctagaaataattcaataaactagtgagatcaatgactcaccttaaggtaaaatagaagggaaacaaaagtaatctatggcgtttgtactttgtggtggtgaaaggaatcatagcatgaaacatgtttctgatatttttttttttatttgaatttatatcgtgacagtcagaaagctaccttataacataatttgagtaaaacagattaaaaattgaaaaatatggagatctttggcacatgggttgaaaatgtcgctatgtgaacctctccttaacatgtccttttccaattccccccaattaaagtataacaagacaacaaaaagccaagggaaaatcattatttaaaagagagactccataatccatgatgctataaacacagataatggatccaaccctccctaaaaaacaactatttccattttactacgtcaatatcatatatccatgccatcaacattagatcaaaattcacaa

SEQ ID NO: 6478 - DNA, 1000 bp, Glycine max
  Soy_ogl_2717 Gm08:15852301..15853300 Cluster 28
atagagaggcaatttggcaaaagaaagaagcaatttggctcagaatattgccacgcgtcctcagttccaaagtttcatggctctaagggattacatcttctcatcagttggagcacaaggacttccaagttcaaggtcagattcttataggaattttggccatcaaagcagaatttcttcaataagacctcagattgcaagcatagaaagtgttgcatctcatcaacaccacagctcatatcaacctctggtttcttcttcagttacatcaagttcaaggtcacattctagtttatgttatgaggggagttctggccaggaaagcaattcttcactaaggcctcagaatgcaagcatagagaggtgtgataagaggaaatttaaccaagaaagcagtagttcttcaatcagagacaaaaggcatgctgatttgaatgtcaagcgactgaagcctttatcagatgacaggaaatttgtccaagaaagaagtagttcttcaatgaggccttagattgcaatcagggagaggagccctgctgattcgaatgtcaagcgactcaagtctttatgtgatgagaggaaaatggaccaagcaagcagttcttcagtaatagtaactcataatgcaatcactgagggagatgggcctgattttgatttgaatgtcaagcctttgaagtgattatgagaattctggtcaacaaatcagttcttcttcaacgcctgtgaatggagctcaagatgaagagaggtttgatttgaatctcaagccttgaagtcacaagttagtctaatttcatgttctccggtgaattcactagaattatgccaatgttgagggatttagaagtgatttgcttgcatgagattagaaaattcatgatggcattagagtttgtagttgtctggtatgcataatatggacaattaagtcatttcttggaacataatggtaataagacttgttttttctgatgatcattatcaactgtgtagaact

SEQ ID NO: 6479 - DNA, 1100 bp, Glycine max
  Soy_ogl_3101 Gm09:33215901..33217000 Cluster 28
agacatcacttttttgagtcaacttcccaaccattgcatatctgcgaatttgcttggcaacttggaagaagctaagaatcaataaaacaacataaaatctcaaaggagcaaaagagttgaaatgagaaacaaaataaattaaattaacaatggaaaaaaatagccaagcagacatagatattgttttattaaaagtttatgaggcatgtggactcatcaaccgcacatcatattgcctaaacgacacaaaccataaaaaatatcaacagctataaacaaaataccgtgttgagttaaattgttgggatattaattcatcatatttcaatagtgacatattgctcaggaacatcaaatgcgcaaacatagaagctagaataattattattcactggcattcgttctaaaaacgggcttgatataagtatctggctttcccgtcttgaaaggaagaaataggaagtagaactttgattttctagtgatcgtaaaacattgattttagttgttttatgtttgggctgaccctgatgatactcgtttggttttggtcaagggaattccttcttggatgttgatgctcgtgcttggcttcttgaggggttggagggccctcaggctgctttatttattgcctgcttatggtagtctcagagaagcaggagtactttctactttgaggaatctcatgataatatggttcagattgttcatcaggtcaatgttatgagagatatcattttgtcttgtttcaatggtggagcaaattcttcgaagccaccaaggttgacttgttggagacagaattttgataatgttgatggtagctcccttggcaaccttggtcttgctggttatgggagaatcctgcgtaattctgatggcgaatggatctacggattccatggtcacattggtaactccaaaaatctccatgctgagcctctttacttccttcggggctttccttacaacatgctagtgatgttgtgggtgttttccacctaaggcttagcttttgcttctttctccttgtcaccaaaaaaacatagcggtgttcaatcaaatgtaaaagaaccagagagcttgctccaccacta

SEQ ID NO: 6480 - DNA, 1000 bp, Glycine max
  Soy_ogl_4397 Gm13:31907601..31908600 Cluster 28
cgaacgccgtcacctccgtttcgtacgagacggtgcgtccgatggtggcgaagcggtgctccttcttgttcctctgcttgagccacacgaaccccgtggggcggttgtaacccatctccacgatgttttccagcgggagcaagcctctcgggagaagaatctcgtctaggaggagacgtgacttttgcatgcacaatgcttcgccctcgtagatctcagcttcttcgcggtggtgctctatttttgcgggaagggaacaacaacgtgtgaaaatatatttaaggtttgctagaattagaaatgaaatgaatttccaccagaatcatctttgaaatgagttaggtatttcgtagtcagtgagagagtaaaagctaattaacttattcttagcacaaagattcttttatagtttcctttgttctgaattcagcttttgggccttgattcatgtgtgttagctttgtggggcggggtgcttttgggtttctctttgcagtggatcggctcatagtccgagcctatatcataacagttgtccctgagttaagatctcttgaatacaagtgatgctagctttagtggtgaagttgaaatattccttataacaattgtcaattgtccctaagtgagtatctcttgacctcttaggtacaagtgatgttgacttaagttgtgaagatgagatcttttctataacagttaccctaaatcgatattgctgaaatcaacttaagttgtcaagttgagatattatgataatgattacattaattctttgcacaatctacaacagcaagagcacaattcaatgaatagttttttttggcaaaatcagataaatccaaaagagaagaaggaagacatattcttgctatcttgtaattggttgtcaacttttctctattaataaagaattgttcttctctctctctatataaatcaattttaatctccttcacacctatttaaaagacaaatccatctactagactcttatctt

SEQ ID NO: 6481 - DNA, 1100 bp, Glycine max
  Soy_ogl_6689 Gm20:1904001..1905100 Cluster 28
tgttgtctctcttgaactgtagtaagagcattaagtcagaatctatcgctcggcacgaacttctacatggccctgctgaattttagggggcagtggcgaaaaaaaatgccctgataattaaaaggttgcgtatagaattactttaaaactagtatgattcaactgctgcataagttgtggcatttttctttctttttcttatcttggaatgcaaacatgttttcaatatttcaatacgtttctcttaggtggctcaacagggggtctccacgtgtcaaatttgccttaactttggcattatcatctgaaaccttagacaaacaccaaaagcctcgaatgtagtttggaaccagacaaccccaagtaacggcttattgttcctacatcatatgtagagctcaatagctactccacttcttttattccttcatcataatcatactttttatatgctatactattgttcacattccctagaaccataataatacattaaaatactataagaaaatcacgtaacggctgattgtctcctctttttggttggtaatgaagcagtagccaccaaaaagaatacatgaaaatgaaaatctcgcaatcactcaatatattccaaataatgcttaaaacaatagtgacaaatagttgagcagcactacaaccatcgatattaggagagcacaatctcaattgtttctcctatattaaaaaaatgttcaccggctctggctaatcacagtgcaattctacctgtcgaaatggcaattaaaatagtcaaaagaaacactagtctgaataatttatcgaattaacttttgaaacaaattacaatcccataatgacctcctgaagatttaaagagaaatgaagcttgaagagaatgtcaaaactttagccctgacctccatgatcttctcaattaaaatctgaattgcagcaaaaagattgaggaaacaattaccttacagattacttacacatagaatcgcttgatgaatatatattcatattttggagataagcaaagagcagatgggagtacatattttgacttcagtagcctcacccatgaacataaaaagaaaaaacagaaatgaggc

SEQ ID NO: 6482 - DNA, 1237 bp, Glycine max
  Soy_ogl_2697 Gm08:15073301..15074537 Cluster 28
tagcttctaccttaatttcatgcatgccccttctagatctataaactttttattcaacatatcaatttattttaaggaaaaaaaaaattcaagtacgaatccaagtggcctttgtacgcccatttttttttttcgttttcagggaaaatgaacaatagcagtgaaaacatttttatttttaggggaattgaaaacgcggtggttctcaaggaaattataatcacatatggatttttcaatttttttaccatcttcatcctccttcctctcctccttgaatcagtcatctataagaaccgccacggctatgtctccctcctcctcgaattctctgtattgaccacccgattggtgaaatgacgaacaacacccataaaaattggggaaaattttctgataggtaccaacccaaaatgtttttgagctttccgtctcaaggtaaatttttttaaaaataactttggcagagttgatgccggtgagatggagaggtgtgcacattttcttagttgtaaaattttacatttataggtacaaatcctagattagtttacacttgaaaacctattttccatgaaaaatttaaaaaattgtcgaagtgaaaagacaaaactttgtcttctgtgggaaggataagtcttagtaattcgattactttacctcttttttttgtttttcctttttcaaagtgccaaaatcgtgtggtgaaaaaacttgttagtatataaaggaattttttgtggggtagtgaggagagaaaaaagaaaatttgttgggagagttgagataaaatttgtcaacaaaaaaatgatggtcttggtataaaaagtattcacttttaatcaagttcttttggcaaagtggaggtgggaattaatgatgagcaaaaaaggtttatggagtgaggtggtggagtcaaaatatgggggtggagaggtttacaacttgatagggtaaataaaaaatcttcaatttggtagagagatttgtgtactgtttgtggggggcaatcttctttaaaatggttcaaaaattcggttgagtggaaggtgggggtggggagataaaatcttgttttggagtgatcctagggtgagtgaggtgagtttggctcataaatatcctagactatttctaaactcttgccagaggaatacctaagagatgttggtgagtggtatggggttgagtggaagtggaacttggagtggaggatggagtggtttgaatggaagaa

SEQ ID NO: 6483 - DNA, 1200 bp, Glycine max
  Soy_ogl_4776 Gm14:44697201..44698400 Cluster 28
ttaagaataaatttttattataattatattaattattttaattaatttattattaattgttaatcttttacataagtaaaatatgaattagcagtatgaatatgtagttacccaataaatgagaattaaaattagtaacagtataattagctacccaacggatataaaaacatgtcgtgtactattttacccattttcatccctagtccatacttgatgagcatggattccaggatgtgacttcaatctcagtttaatatttctttcggcattcttttcactttgtgctgcttggcatatttggaaagctggcaatgatgtagtcttcaaggacaacaatcgatcaatctagtacattatcaaccagattcgtttgcttcataataccattctctctgcggttactacttctcctgggcataaacaacctaagttggtctcgtggctaccacctcctcatcatgcagtcaagttaaatgttgatggaagttccattggcaaccctggttcgtcatgatttgggggcttactgcgtgactctcttggacagtggttgattgactttgctggttcatgtgggcattcaaccaacattgacgctgagctttatgctatttacagaggtgtggcgctttgaacaaagtctttagaattgttcaatgtgaatcagactcgcttgtggctttggatcttattaatcatgatcaacctccgtggcatccttatgttgctttgctcaacacgattctatctttcaaagatagacctcggttcctaagttttaaccatgtctatggtgaagagaaccaatgctcagattggctagctcgcatgggatcatcatctgcagatgtgttcactattttagattcctcacctcatcccctggcaactttcttgttagctgatgccatgagggtttctttctctaggctttagctttgtgtatctttcctactcgttaaaaaatatcttatgtttgaggcggatcaattatgagtgagacaatattacttacacttttatcaaaattgcatgatattttttttaaatggttttctaatgtatttttaacttttaatgtgtatatcacaatactaccctttttttttatcaaaattgtatatatttttataaaacttaatttctaaaatatttttccttttaatacattattccttttctaaattataaaatata

SEQ ID NO: 6484 - DNA, 1100 bp, Glycine max
  Soy_ogl_456 Gm02:9386601..9387700 Cluster 28
cttgttctaagttctattagtgattttgggatcctccagcattttatggtaccggtgaagcctccaaagcctgagcaagtgtattgattcccccgtcacttggttttatagaatgcaataatgatgatggcgcagctaggggatcacttggcggtgtagcttgtggtggaatctttagggattcctttggtgcattccggagatgtttttcagtttatattggtgtaaaaatagctctccatgctaagatttgggcagctatgatagccatagaatatgtgcacttagtgagttgaaccaaattttggttagaatgtgattctaagttggttccggatcctttcaagaatgagaatattgttccttgggatatcagaaatttttggaagcggcgcttgaggctcagtcagagattgcattttatgtgttctcatatctacaaggaggagaactcttgtgcagattgactagctaattgtgggattgatcatagactagatattacttggtgggattctcttcctacatttgttaggaattcttttgcttgcaatcattgtggattgcattctttctggttttattgattgtcttcatgggtttggcctagtcctccctatgactcttgtttgatgttcttttctctttttttattataataataagtagcttgtagttgatgaatggtagtcagaggggtgtcaacgttgttaggatgcctctgttctattgtaaggcttgatagttgaaaatttatcaaaaaaaaaaaactgtcaattcatatagaatcaaatagctcgcaaccagggtcattagttacttctcaacataaatcatatgcacatgcatgtttgttgtatgcaattgtcctttgagaatagtctaacttgtttctgatttcttattttcagcagcagaaggagcaggatcccacgccagaaaacacttctccatttcaaatgaacacagaagatccttcaacatccaaaagtaaaccatcttcttcacaagtaaatgataaaaatcaatctgtactgcgaagcatagctgaaatgatccaccaacataagcaaattgtaaggggagcaccagtgtctgaa

SEQ ID NO: 6485 - DNA, 1014 bp, Glycine max
  Soy_ogl_3848 Gm11:16465187..16466200 Cluster 28
tgaaagagcatactatatattccaagacaaatccgatcacaagaaattttgtgtttcttatttagaaaggaaaccgaaacagaaatatgattgtgccatttaaaagaatgacactgcataatcaacagcaaataaaggaggaaagttaacaaaaacaccattctaaacacatttttgttattgatttattttctaaaacgttgatactctctttaaaccgcaacatcatttatgaatttatcagattggtttttcaaaaaataaattaatacacatggagttattgttgttctctgcttcattgtgttataggttgcttgttgactccagtttctacgccaagtgagtgacagtgtgattacgcccactcatgttgttaatgcgaaacggtctctaattccataaaaaataaataatgtaaatataaacacacccaacgcactccgacactctgagtagacactctctaattgatcttgtcattttcacaatagatgggtttgggtgttctatccttcttcaagaaattttgccacttaccactgaaaaggaacaaaagataataagcagatgaatttgtggcccataggccatagagtgaaagtgacagaagaaaagctacttgaggagctttcttatgctaacttcaacttccttggttccgcaaaggacataaacttacacaataatactgttctgaaagggtattatcaaccagttaatagataaagaccagtaatatataaaggcaaaagaagatgcacaatagcctaaaatcgatttaagagcaaccccattcgccaaattcatcttgtcattttcctccgttttaacattacttgcaattcagacattattggggtattgcacgacttccaatttttacactcagattgtttatatcttcttcacacacagttgagtgacaaatgaacagtttccattgcatatttaaataaagtatctcttgccatcggttctaataaaacatgataggaggaggctcctctatga

SEQ ID NO: 6486 - DNA, 1497 bp, Glycine max
  Soy_ogl_3439 Gm10:38022804..38024300 Cluster 28
catatctttttttctcctccctccccttccaccaaacaagccgaaagtgatcaatggctgagtttttaaaaccactagccagagtaagacatgaaaagcttacatcttttttcctaaaagatattgaagctacactttatggcgtaccaaatccaattccaagaaaatcaggcaggaaagccgcacctaaaataagtttgtcttttatcaaagaattaggtagtattattacattaattttgtttatgagtacattattttcttattagtattttagtttaagtaatgtacaaaatacatatttatttttatgaaccataatttttttataggaaaattaaagactaaattaaaatttaataatttttcaatagaattgattgctgtatttcataaacctcgtagctttctgtcaccctcttcacttttcattggagtagtggtgtttttaggtgaagaaaaaacaaatcagaagttcctcacaaaatctgaataaattaaaattataacaaaaagaatgcgtaagtgcagggctgggaatgaaaccttaatctaaggtctatgaaatagttttgccgcaggacatgttggggaatatattatgtatgagacataattattttttatttataaaatttataactcacacacccagctatacaaaaagatatgcatattgaatatatcaataaataaataaaaaacaaccatgaatcaaaacaagatctagcgtgtcatgtcactagctagttgtaattttgatattacccgtcgaaaagggtaattagattgggacccaataatgtgaaaggtgagtgagtggtcaagattgaaaggcccacgcttacgtacattgtaatgtccatttcaacaaaaacttggtcgatccactgaatgttgttcttgttcccttgcttgtgtattatgtcagtaactatgatcactgcatcaaatagaaagccaagcctcttgacccatattttagtggaccccactctctaggtatggtcatatggttcatggcctccctgtcggtagcatgcatttatcattcaactcccttcgcacgttatggctatgtgtcgaatattggcatatcaattttggtgcgagatgagaggggtcaccacttgtgatgactttatttattgtttaggatgatagtaataaaatctcacattatctagcaattgacatcatagaacaatgattgttttataaacatcctttatctcaacctctcaatttacatatacgtcttttattataaataaaactatggttcaccgaacacttaaattgataatatctcaaatacaaattgagaaccctagtctgaattgtaactcgtgggatgaacaacccagttccatttcggtgtgagctagaaccatgtaagagtttttctttttctttatcaatcatgttaggtcgtgcaatgcacgtgatggagtgataagcacagaaaagtatgtggaatcaatggtggttgtggtt

SEQ ID NO: 6487 - DNA, 1026 bp, Glycine max
  Soy_ogl_2000 Gm06:17149624..171249 Cluster 28
taatacgtgttcatttaaagttatattataattctgatattaaaaaattaaattgagtttcttaccgccaagaaacacaaccagacaagtccatgccaacacatgaattttattatataaaaacttgtcgtggacaaaatttggtctgtcatctaattcttgataccattttaatctgcaccgaatatagtataattatatagatcttatacgtgctagtatgtaattttcaaaatattttcttgtcttaattcattaaaaattctaatgaatgagtttgaaaattgaaataaagatatggatgagaactgtgggttagcacctacaatatcacgccacattcaacatcttgtcggactcagggtcccacagaacagctacgcttggcaagtatctatgttcccctgaaactcttcccttcaataacataacgacacgtggcaaataacctcgggaacacagaagaagacgagccttaagtagtgttcttaagtgtttgattcaatttcacatgaatatatatgataaaaaactaaaaaaatatgaatataatttactttaattcaaattatttcattttcttttttactttcacctttttcaatttttaaaaccaaatggtgtctaactcactcactggcgtcatcactgaaacatggcacccagccaagtgttcacttgaatgggcccagccggcccattataagatttaaaaatcgccttttttcttgttggtgtgggttcctacaattgaacctaacgaactgaaccagacaggcccagttatgttaggtaggtaggtaggtgcgtttagtagtgaactgggattcgtatctttttcttctcatttcatttcgtaattttctctcctcaatcatgcaatatcgtagaccctgtcccatgagcatcgacatcgccaattaaatgtatctatccacgttcccttacgactaaccatacttgatttgatgtgaacttctaactaggccagctttttaattataggagattaatgtttatatacag

SEQ ID NO: 6488 - DNA, 1000 bp, Glycine max
  Soy_ogl_5334 Gm16:7146901..7147900 Cluster 28
caatcaaaccaatcaatcaatacaattatctattttcagctatttttcttctaatttactttgtttctatcttgctattttcaaattcatttatcttttagtcccatatctttttaaatcttgttacaattcactttcaaccaactactttttggggtaacttaggaacccattacatttgagagacaaattttctcttttagctcacaaatcacttgatcacagatttaaattttagaatcgtgttgaagcaaacgttagccaaaacaagatctttgttgaagagcataaaattgtgttggaatttacctcttggagtgtgatattgcattgaatcacttagtcctgcaaacacgagttgaacctctagtgcgtccacatgaacacagattcctctaccgtctcacgccgagaaaaggtaagcagttccaattgtgtgttcaatagtttctaaaatggttagggtttctcatgctcactaagttcctttggcactgcctatatatagaatctccttagaaaccctatctaagaacaagatccaacaaaaaaattggaaagaaaatggattaggatacacctagttgtacggaaaagccaacaatgaaggctaaagagtgctccatatgaatgacataacgttgatccatgatgaacgaatcaaaccatgttataggatgatcaaagctcttttaggacacttctgaggtctctcttcactcacatatgaaattgggttttcgaaaagagatggtaagagataagaatataaaaaattcattatttaacaagctcaatgtaatcggttattttattcttcacgtttctgggtttgagtctgaatgtgtttaatcaattgaagtgacatgtaatcaataaaaacaggagtttgacaacaaacaggaaagcagagcactccattgtaatagcttaccattcttgtgcaattggttacgcttgaagctggttcccatttggcttgaagtctaagcttgagtaa

SEQ ID NO: 6489 - DNA, 1083 bp, Glycine max
  Soy_ogl_2731 Gm08:16876718..16877800 Cluster 28
ctctccccacgttttttcatatattgatttgaattaattgcttgtgaatgtcggtacatgaatgcatatatacctgatacctctaccttctttaaaataagatttctttcattaattttgaaatttctaccgcttttatttataagttagcagaagaaaaattatcattataaaaaagtagagagaatactgacatttattattagagtacgggttaagaaatcaaaatcttttttttcttcttcttgaaagtgctatcaagaattaattctttcattagtgtccttatgatattcgtcagtaggaaaaaaaaaaaagaactatcaccacacacacgaatttatatgttttgcatttaatttgcgaagtctatcaatttcaaacttaattaaaaaaggagaaaattatctacaatttaaagaaattctctttaccggttgtgtggatggtcactatgtttatgaaaaaaagaaattctaacggttaaataatctgaacaaactatagtaatagcctaaatcatcacgaaaaatattgatagttttattgatttcgttgttaatattggactgttggttttgatgaatgatgatgatgtgtagaataattgatgcccaactataaaattatacaaagtcgtacctagaattgggatttgggagatgagttagaaattaatctgttgaaaggatgatgaaactgtgagaagaattaatgtgatgattataggttatatggtctgatagggaacaactaccgtcacgtgtgactctgtggggctatggtgtgaatctcatgcccatgttgaagccatgggaaacatatgctcggttggggagagacattttggttcaattaacaacgttcggatatagtttagctgcgatcatttttgtttatatatatgttatgatgttcgtctagcaagttccggaaacacatgtttgtgctatatatcttgtatgtataaccggcaacattgcaaccgtgcctaaaactggtcccaatatattctgaaaaacgactcttcatatataattaacgattgtgtctaggcatttcccgtgtggagacctgattaaa

SEQ ID NO: 6490 - DNA, 1200 bp, Glycine max
  Soy_ogl_2789 Gm08:22459001..22460200 Cluster 28
ttatggtcattctacttgaaattagatacatttcaaaataaccaacaacaaccaaaacccataaaggataattctcagacatccagtgattaattggattataaaatgataacaaaagggtttttaatttgttttttagaatttttttaaaattttattttcttagggacgctggctagcctgtttagcctagggtctgaacgatgcaattgtaggatcactaaaggataacatgtttaaattgcaggctttgcaaagcgggttatgtgggttgtgggttttgcaaagccaaactaagcaacctcaaagaagatttgattaaataatttttttgcataaagcaacaatgagagcaacatgccttcttgtttgaactttgtaaacaagcttgcaaagtaatgatcaacatttattaaaatatacacaaaagatataatgcatgttgttttgttgagaaagctatgcatgaaggttgttttgggagagtttaagaatgcattgtgctaccattgatgcttcgattcatgcaaaaatggttcgatcaaattttctttgaggctacttgatgtgatgatagagaaaggaattagaccaaattttatcttacactttccacactgtatcactcctcccccaactctctcactaacttcaatggtaccgccgacttagatatgttttcctttcctcattacgccttctatctctcttggcttcccttggatgtttgtctctttcccactcccaagtcccatgcagatttggcccaatggtatgagtctgggtcatgggttaagaccaagagcaacaattaaccatcacaatcgggtctaatggtagagcaaagaaaaacaaaaaagtatatggtgtggcagatgcaccttagtgatttgcgagtaacattaatccaagggtaaaaatacaatatatattaacaaaagatctaatatataactctctcatttaaaataaaataaaaatctcttaaaaattactttacttctcaatctatgttggactgtcactggttgctaaaattgcataacacttatttttttgggtcaaaagttgtctcaaaggtttgcatcttttcctcttaatattattattgttatcctttaattatattagtgaggaatgaagttctactcataatcttttttatattaattggatggggcaagcatagcaaagtagtgg

SEQ ID NO: 6491 - DNA, 1100 bp, Glycine max
  Soy_ogl_2869 Gm08:43360701..43361800 Cluster 28
tgggaccaatcaggaagttcagatctgtaatcctttcgtcctctctgacaagtgtagctgcaatttcaactgtccagaccttactcttagtagaaaagattaaggtcatggtcaaagcaacattaaactaatgcaaaaatggcatacctgtgagcccaattttacaatgagatttagtgatactgttgactttacgaaacataagggccggaaccacatgcacctgtttatcatgccaagatattatgcataaggaacaagaacaaccttatctctagtgtagttatgcatcaaagataaggatcaatgtaacttatctctactttccaaaggttgcatagttctaaaacatgttctgaagtctgtatattttcttttactaaaacaaaaacttcaattttccttcacgacactacactggtttaaaatgaggatgaaaatatgcaaaactggaacagcatgctcttaattaaatttagcatgggaagagggaactgctagtgatatctgtccttgcaatttgcaaatgttgtgaggattaccattttcaaacattttattaaggctcttcgcttgatatggccgtggttgtgcttggggctttagttccatgtcaaggtctgcgtccacctgcagcattgaaagagttataccgcaagagtcacacatgaagtttatactccatgaccataaatttgtaaggttttgacatcaataaatactatattgattataatcctcaatgttttttagtagcagatgtatataaagcattactcaccgtatcatttctgaagtcatactcctccaacatgggataattcaaggcatttggcaagcaacgttgctttacattttcaagctgtatataaatcagagaaaatcttaaatataacagtttgatgtatcctaatgggttcggtttttctatttctctccctcagcgttttgtggttatatgtaattgggtgagttagaaaattctgttgagtatatttttttccccttttaagtatttattatgtcttttgctaagtgagcatttcttatgctttcacttagttttataatatttattggcttataaaaaaactctattc

SEQ ID NO: 6492 - DNA, 1124 bp, Glycine max
  Soy_ogl_6645 Gm19:50347777..50348900 Cluster 28
ccagaaaaaaacgccacacagatgaaggttgaaatctacctctttactatattataaagacctaatattattaataagaccaataatatgaactcatcagggctgagggtttttggggatgttacaacttacaagtttagaaaaagtaaaattttagcgtacattgagcgtcgtagctagctatattatgaattactagtgtattagctttttttctcagaatcatttaatgtatttatacattaaataaggagacctattacggtgcggatatcgttaatgatatttatttgctcattatcaaatttaacagagtgggtaagattgatctgcatgcaatattctatacagaaaatgaatatcatattaatatatattagacagaaaaacactttagagactcagcgtttttagaagaactcactttaaatttattaggttcatctatgtatattgataggaaacaaaagcatgcatgatatatggaccatctcaggttgaagaatgggagagtccaaggcagaagtaatccccaaaaatggcagatccatgatcctcttcgcgggttttctatatgtatattaaaaaatgataagataacggatgagctgcatgcacaataaatgcggttgaggaccatgcatgcatgatagtattgcgatggtggtggtggccccgcaatagtaagtgaccactgatataaatacacagagagagagagagggtcgtaacccttttgtatatatattttgatttgattcctagtgaacaagctacttattagtgctgccctgccctccaaaatgccaaacccaaactagtttctagttacatgaacatcatttgggtatctagttacctagctatctccaacaccgtccacatgtcttgttgtattttcctcttcttttgtctgttttggttttattgcaccaaatttgaaaggaacaacagaatatgtaatctgtacgaagcttctctagtggtacccatttatgtcgttagtttgggacgtacgtggagcgtggtggtctcatttccagtgtccacgtgggttaaattgtcctgtttttggcttcaacttgaatgacaactacactatttatatatgtaattttactgcc

SEQ ID NO: 6493 - DNA, 1100 bp, Glycine max
  Soy_ogl_2322 Gm07:10407801..10408900 Cluster 28
ctttattattggttaaatttattgaaaaccaccaaattttatagattctacttctaattcaacaaacctcgccatttttgtaattttgaatgaattttaaatagtaagaaataaattatataaaaagtgttaaaaatatatgttgttagcacttttcttagaacacctccaagtcaccaaggcacaactttaccgctgcacgaggactcgccctctggttgaaacttattaaacacaaattcttattaagagtaactcattgaaaaagttcttatcaagtactcatgaagcagtggatgcttacatgaacattggtccttaaaattttgtgggttccacgtgcatgtatttttaggaaataatgataaatataaggacgcaaggttatttgtatgattcatttagtaaaagtttttaaaattgttagaccgaagaggtgtattgcttaaattatgagtgatattgtcatctatgcacttgacatactaatggtaatgtctgattagttggaaaaaaaaaactatattataaatgcataactattaaaatcattatattctttttctttttggtaaaagaaaaagaaaaccacccttttcacaaaaaatcattagtgacaggtaaaatggattgtaacttgtaaagtgcaacataaccgcaaattattgaggataccctgtttatagaaaactccattggaaagagatcaatgtgccgcagtagtgcaagttggctgtatataaagggagcattagcctctcaacatcttgcggttaggttgcaatttgcgagtccatgtgctgtcttttcttttgtccctaattcgaagagcagcacctcagtactgctaacatgccaggttgtttcacctaaactgtggtcttgtctctcgggttctaggcagatgtttaaatttcacatttcattgaaacccttttgccttttgccttttacagagacacatgcaagatcatcttaaatttcacatgagtgacatgtaatcttacatgattaatagataattttgttttttataatatatggttaagagtttgatttttaagtctttgtgtataaaaaaatatctcttaaaaaagtta

SEQ ID NO: 6494 - DNA, 1100 bp, Glycine max
  Soy_ogl_5381 Gm16:30878701..30879800 Cluster 28
cagaagcaccaagagctagcaatctatcactgtcaatcatgggaaacatacctgacacataaaagggaacatcagaagcatcaacaaaaaaaaaagttcatataaaaatcagttgcatgcttctttaactcctcttgctccgaaatccaatcaccatcttcattttgaagagtctcaattttatttttccatcttttaatgatcatcgtgccatgaaataatttggaattacggtctccaaaggccagccacttagggcgagatttttggaaccacagaatatccttttagatcaaaacttcctcataatctttccaaaccaaattaatgtcatcaaacagttagaagccaaagatatctttatattcaaactatttaacttccccatcaactttttcttatttgcaaaaatattaccaaagacctctttattccatttttggacatcatcacggaaatgatttaattgagcattccaagttaagccttgtttctagttctactttacaaatctatggaaatctgcatgagttatccaagaggccaaaaagtgaaaaggcctctcctatgactatttttcgaataattagcacaaaatttcaccaagagaggtctatgatcagatttgaaaggcgataaatgcaaaacaatagcatcttgaaaaagaagcctccactgcaggttaattaacattttgtccagcctttgctccaagtttcctcttttcctagtgaaagggtagccttgaaaacctgcatcaataagttcgcagccattcaatactccctgaaaaccaagaatccctctcaaggaagggttcacaactccaccacacatttcatgaacatgaagagtagaattgaattcacctagaagagcccaaggactattaatatcagaagttagctctttaaacataccccataactcctgtctatacagaaaatgaggactagcataaacaactgtcaacaaccattcagttgaatgcttccatcaaactttcatgtgaacaaaatatttggagtgatttagaatcaggaccttccacaaactagaatcctaaatgcaccaaatgcctccagattgtccactagcat

SEQ ID NO: 6495 - DNA, 1000 bp, Glycine max
  Soy_ogl_4295 Gm13:27090501..27091500 Cluster 28
atattataataagttaaaaaataaacaaagatctcaacactttaatatcatattttgattggtttggtgaatctgtttattgagtagtagtacttttgaatgtaacagtaaacaacatgtgtaacaaaaaaaaaagtctagtatcttttatttgcaaggttgatggtgacaaacttttattttttaagactcattattagtatatcaaaatatgttggcacttaatcacaatattaagtaatgtagtaactgttgatgcatgctattttatagaactatttttggaatagagcatctattgagggaacttagcattagacatagaatcaattattcttgcccagaacagtggagaccttttgttgaataactttgttattcacggataaaaaataatgatgacaatggggagaaatagaagcaaattttatttatcatccttaaaatatatgaatcattcaaacattcttggcttgacattcgtaaataaaaatccaggtaacaaagcaagtaaaaaacatactatacaattcctgtgaaaccaaatcactttagtagcccaccccatgtgcaccaagagaaggaaatcccccgacctttgattctagtaacaggattattagcgggtgatggagctagtgcgccattggttggtcagagagttttcaagttggaattttattttgaaacagaaaaagaaaaagaaagaaaaatcagttatcctataatataagatcatttaatcagtttttaaagagatttacattgcaaaagcatatgcaatagccttatagcccctctaaatgcaaaacgcgtctataaatgaatgatttaatgaataaagacattaaagttccaactaattatggagagcttttggtagaaaagttggcaaatgctcatctatataagttgatagagaagttggttatttcatgctcatccagtgactgcaatcaccacatagtaaaaatgtaaaacctaaattgtttgttcatgt

SEQ ID NO: 6496 - DNA, 1066 bp, Glycine max
  Soy_ogl_852 Gm03:5139435..51170 Cluster 28
atcaatatgatgaagagatcatacaattacttcaataatgtattaaattgaataaataagtgttataagtgaaattatatatggacatatttggtaggggagcttttttttatatatatcagcaaaatagcattgaaatatatatatgaatacaaggggtatgcaacccttttacaagtcacatgtagtgtataggaagagtccagatcctctgcagtagattaaaggggtatttgaaacagtagaatttttatttgtcaatcttaattttaaattatatacctaatcataccagatccattctatatacatgattgttattaaaatactgcatcggtatatttatggatattatagaaaatgaatctaatatcattagttgtatagtttaagattagtcaataaaagttttaatgttttaaatagtgctctaatctatcgcaaaggatccgcacttgtatagggatgttcactcccacctgcccctctggatggttacaaaatataaagtatatattgaagttatcatgccacctctagatggtttacggggcattaaatgtaaagttagtggttgaaaattatttatgccaatttggtcattaataacttctagccaacctactatatcgggtttgtgagcctgaatggggataacatacccaattttgcttgtacatgatatggtactgctggtaccatagtttaaaaataaaaattattatttgtcgatgtaaaaaacgataaccaccgtccaaaaatgtgtccctgtataatttataagtctataattccaatatctaaacccaaggctgaacatgcgtggctatcacgagacacgttcaagcaacaaaaacacatcggattcaacaaaatccaccagccccagatgaccttcatttgcccataatatgaattttgaatttccggtgtatcaaacgatccatgcaaagtctatttccatcgtgttactttcatcccacccacgaaaacttcacagtgaggtgaatgtgttacatcaaatgattcttgtcaaactctaacccttcaaagatacatttgttcc

SEQ ID NO: 6497 - DNA, 1000 bp, Glycine max
  Soy_ogl_5183 Gm15:49973901..49974900 Cluster 28
gtcccaatctattggccaaagtataggtaactacattggtgattttcttgagtatgatgagaagaacaacacaagctcttttcggccattcatacgtctaagggttcttttggatgttcgaaaatcattaaagatatccaaaaaaaataaaaaaatcaagaagccaaaaagggtttcaactgaagttttttttcaagtacaagaggcttggtccttttcgcttcttttgtggtttgatagggcatgctgataaactttgtgaaaaattgtttgctaatggtgttaatgatggagttatcttgtggaatggagatctttggtcacaagcacgtgcaaacaccagcatgaggctcccaacttagaggctcataggtttccatggcatccctgatcgtgagaaaagtctgattcatggaatatcttgaggagtttgtatgaggattaatcccttccttgttgtatttttgctgactttaaggatttactgtctaatgatgaaaaaattggtctcttagatcacccctcttggcttcttaatggttttcatagtgttgtttcaaattcaaatctccacgaccttcctatggagggttactaatacacttgggcaaaatgaagaggtaaacctgatgccgttaaagagaagctagacagagccctaacaaccctttattggatcgaacttttccctcttttgaggctgattaattcagtgtgctctaaatctgaccactcccaattctcatcaaattgcatggtgttggtctataaaaccaagaagaccttttcatttgaaaattcatggctacttgaagacgagcttgttgatgttgtgaagcacggatggctgaactcctttgattatctaatggaagaaaaatcaaatcttattctgctgaaatgaatgactgggggaaaaaaagatcagaaccagatttcgtgcaaaaattgatggttttattgtttttggtcagaataatatttgtaaggttgtctagag

SEQ ID NO: 6498 - DNA, 1063 bp, Glycine max
  Soy_ogl_5977 Gm18:7338238..7339300 Cluster 28
ggaatgaaattgatgatttattcacacatcttaccaaatgtcacaaatatgttccaaatccccaataaatggtaatctcttcatatatgaaataattagctgataactgattatacatggataattattccttttagaacaaaatttatccctagcgcacacatcaatctcgggtcaataactagttagttatgaatcaattggatggcaatgtggcactgataatactacactataacgatgcatgaggagtttgctgtggatttggcatgttctttggtgattaattagtccattactaatcataagactcacattgcagctacgggtgagttgttttttgcttgtcattgatttttttttttggaaaaaatgtaaattatattaaatttaaaacgacacaccaataaacgggacataccctgcagctagataaaatcaaaagtcttactaatacaagaaggcctatatcaagatgttaaaacaaatgaaacggatgtgtttgtctatacataagaaatttaatcttactaataacctctattaaagaaaattgataatctttaaaaatgagtttgtttctagacagatgtataatcagacaacgaaattttccttgaacacgtgtgtatctgtccctaattaaagactcttattgatttaggtagtgtgaaagaagatttggtggcactatcttgctagaaactatcgtatgttttgtatatatctttcctacctctctcacctcttaggaaataatgcttcttcttgctgtaatggagcagaagaaagttccatgtgtttttttttactgtaatataggtagtaacattactcgatttaaaaatttgatgaagtcatttatttgaacttgaaaccaatattatcaggactcaaaatatattaagataaaattgagtcaattcacatattttaacgtaatatcaatcgtaatattacgtatcatcaaatcatagaacaaaagaaatataaacttaaatcaaggtatatttgacaatatatatttaaaaatatatcattataaatataacatcatgttata

SEQ ID NO: 6499 - DNA, 1000 bp, Glycine max
  Soy_ogl_4979 Gm15:10830901..10831900 Cluster 28
tgggacacaaataattggagtgtgactgttaaaaggagctaacctcaattcattcatatggaagtgagatggcacaatcggagatcatggttccttaaggcaatatatggtgctaggcaataaaccttgtgggatgatctcactaagattggtaccactgtagttggagaatgggccattgttggtgacttcaacaacactttgtctaccagggagagtgcggaaggtgcttcaaaaggggggcatagagatatggaagtttttttagactttgtccatgaatgtagtcttattgatataggattttaaggagattctcttacttggcgaaatagaagaaatggggtgagacttgaccattgcttaattaatatggagtggaggttgaggttcaaagaggctactttgatccaccaaatttagcttaaatctaaccataggccattttgcttgcgtcatgagacttcatctaaaaggaatcaacacagacaactgttaggttcaaaacggcttaggttatgcatgctaaatttgttaactttgtgagaggccactggatgaaagaaaatggggcagattcgtaaagtgatgctatcactgaactaaggatgtcaaacattgggaccaagaggtgtttggttgcatatggaggagaaaaactagtttgaaacgtgaactggcaagggtggattccacaagtagtggcatgtttgatttgtaggcagcttcagaatataagaagacttggatagaatatgaacaagtcttggctgaagaagaacttcattggtttcaaaagtctaaagctaaatggttgtatatgggggaccacaataccaagtattttcatggtatcacaacgatcagacggaagcggaataaacatgatatgttgaaagatgagaatggtaattggatcttcgatactcgagccgttgaaagtcttgtcaccaatttttataaggacttgtacttggacaatggtattgttattccatat

SEQ ID NO: 6500 - DNA, 1089 bp, Glycine max
  Soy_ogl_607 Gm02:422901..42507989 Cluster 28
tcaaagctgtcaataaactccattggatttaaaatccaatctgataaagaatgtgaaaacttaccggcagccatgaccattcccacgtcagaattcgaactttctccaacatttctgatagaagttaacatgtgacttcgtcatatcgcgttaccgtggtactacgttagggtttcaattaccccaatcttttaaataaaaatctgcaaattaacctcaagcaatgcttttatccaagggctaacttgcaaaactcaactttttttgtaataagtcaccaatatttgatcttgtgcgtccaatatttaactaatttatctgacgatctacttttatggtccaccagtgaaaccacatggaagatggtccaccatataatttactttttcttaattatctactatctatataacaaaacaatgtccactggaaattactaatagcctcctttatttactgacacttgctaattgcaccctcctttttgataagtgaatcccaatctttctttttaaatcttaaatacccattatatcctttatttcatctctctcacattctttctttaacgcgtggagagtgatattacccgtactcaagggtatcctaccagtgaaaattattttagggaatgagagggaacaccctaagtcaccatgtttccttgcaagaatctcctccacttcaagcatgcttgtcaaagtgttgaattttttttttccaatcaatcagtgcatccctagaaatttgggtttaaatgcgatatatatggggaatttaaatgtgtaggcagagtctccactacattacactgtaaactatgggtcacagcacctaaacaaatttctttacctaaaaacacattaatatattaatcattatggtcaaattatatattttgattcactgttataatcaatttaactaatttattgaatgttttattttatttaacatagaaaatatgaataaaacaaacgggaatgaatattttccaccaagtatgaagaaaactttaattagacgtacctcatgaacattttttcttaaatcgccttaaaatgaaaattacttgaaagaaattaggtt

SEQ ID NO: 6501 - DNA, 1099 bp, Glycine max
  Soy_ogl_4974 Gm15:10382801..10383899 Cluster 28
atatggagcttaacattgaggagggaatggttccaatggaaacatcgtatggtaaaaaaattgtggaagtctaaggaaggaaattatatgttttagggaagtctacaaggatttgcttgtcaggagaagtgcggaagaggcaaaattcttcgagctcatatgggaattaccggtacgtaccctctaagaataaaggaaggatttggagattgacacataaccggcttcaaacaatggataacttgaagaagaggaagatcatttctacaggtacggatgtaaattgtgttctgtgtaaatcgtgagtggaatttgcagcacatctcttctttgagtgcagtttttctcatcacatatggacaagatgttaccaatggtggggtaatgccggctgataggattgcacacttttgacaacactcggggatgatctaagagaggaaggcgcgcttggcatggtggactgcttggggtgctgtgatttgctctatttggaagctacagaatgcatcaaattcaatagcagcttatgtaatcagaaggaggtggtacgttgatgctttcagctaggtgtagagcaaggttttaaaaaatggtccctaatcatgatttggtacgtaacatcaaagtttttttaactgtttgtgactacaattgaaattacaccgatcacctttgtttttcctttgccacatatcaacaaacgcaacaaaaacacaatgtgaccacgatgactaatatttaaaaccttggtgcaggccatttgtaaaaggatttgaggcataattggttcagtggtggggtgatccgtggcaataattgaccaggatcttctgtaactgataaactttgtaatggaattgacacaacttgtggcaacctttttcctgattaacattaagctttttcgctgttcttaaaaaaaaaagaaacctcgaataactttttgaacaactttcactgaaaagaggataaccaaagatagtaaggaggaagataagattcctatcaataagaagaacaaaaaacacaattgtatttgcacagtaatatgtatggacgttaatttttgctaatattataatgtccactagcaaat

SEQ ID NO: 6502 - DNA, 1276 bp, Glycine max
  Soy_ogl_5005 Gm15:11846025..11847300 Cluster 28
tacactacaccaaagttgcaaatagatagagcttagagagcatttttagggaaaatgccttcttaaaaaaatagaggtttaagaggtcatcatgtttgtatcccgcatcaattctgtcatcatgcttgtcatcaattacactgcccttagaggaaaagtaccatagaagttatttaatattttaaaaatattgagatccaaaacaataagtcatattatcttttctatgttactattaatattccttttgtgtacttaattaggcttaccattggggatagatgcgtttaaactagctacatacaaaatgagaaagaaattgaccttgcagagaaggaagcatctttcatttggagatagagtgtgccttataagttagttttgattttgaataaaattgaaagtgatttttaatacataatacccaaaaaggcacttttgattttgaataaaattcaaagtgatttttaattgggggctaatcaagaagaaagaaaaatgagttggggagcttgagacaaagtgtgtacctaaagttaaggggggaaggggttgggaataaaaaaattagaaatgtttaatagagctttgtcagggaaatgggtttggcttttctcaatgggaaaggagtgcctttggatgaaggttgtggagaagtatggacctctagtgttggaaggatcatttagagagaggatgggtaaggagaggtctcattggtgaagggatgtgttaagggtgagtgagttaggggataaggtgagtttctggaacgacatatgggtgtgacaacatgtgcttgcaaacaaatttgagaacaaaaaatgtgttcggttagacagtgagtacatggttggataatgacgggagatggaacttaaagtggagaagagcttggttttcatgagagatggaattagttaatgagatgtaggatgtgaccggagtgaaaaaaccaacaacggggtggttggacatgggggacactgttgagaagggttatgttgttagaaaggtatatgagttgttgttaggtgaggtcctggttgaggattcattcgtgtaatgggacgatggatatgtgcaggggaagaactacatatgcctttacaggggcaccctgtatatacacaaaaataaattatttacccccccacacaccacttgacatggttattggaagggtggggaagagaaattgattgttgggttttgttaccagtttgaatagcattgtatcttctatgtttcatgttatgccttttttctgtaacct

SEQ ID NO: 6503 - DNA, 1000 bp, Glycine max
  Soy_ogl_5233 Gm16:6301..1453300 Cluster 28
tacagctgatatatctcctgaggaaatacaatatctgttcccaaccatctgaaaatcccttgccagatatgaatagtctcaggacacatgaggaataagtgttgagtggtttcctttctcgaattgcaaaaataacaagaagcttctaaattttgaatctgaatattccttttacgaagttgttcacatgaaaatactaataccttagaaggtgcttccttatcccagaatttgctttgagttattgaagaagaaacttgcagttgtgtggagaggtgtatgctgcagccaccgagaagccttttattgcatctagtgtccaaatccacttatctgatacgagtgggatcatcctgatatgctgtgtcaattgtgataaaatttcctcttcccatacaaataatggtctctccatcatcattggccatgtctgaaatgagtgattccttgttacatgtgatttgaaataatctcgggaatgtttctttcaatggtgcatctccacaccatttttgttcccagaatagtgtatttgtctttggtgcaatcatccaaccagccgtgacatccaattgggttgtcatctatgctacaaatgtctcgccaccattgtgaagaattaatccactgtctagatgataattgcagcaaaggaaaccatatcgaattctgatcagttaagaatcgccatttccatttagatagcaaacttaagttcttgacaccgaggcctcctttatccttcggcaagcaaactttatcctatttgagccagttaattttctgattttctgatatcccattccacataaatgttctctgaattccagctgatgtccttataactttcttaggagctttgttacttggtgtcctgctttctttctatcttatttgaatgtttggtagcggttccattaacttgcaatgttgtattttactttcatgataaaatagaacctcaaggctcaagcaagtgtttctaatttctggtgagatt

SEQ ID NO: 6504 - DNA, 1178 bp, Glycine max
  Soy_ogl_5431 Gm17:546201..547378 Cluster 28
gacagaattaaagaaaacaaataacacagtccaggcaggatttttccagtgacactaaggaaatcaaaatgaaaaaactctgggtagccattaggacaaatattcaatttagaatgaaaatgaaacacaaaagaagcacaagaaaatcaaggaagatgcgatagtttcttagttcttgctccccatttctgcattacagatagttaccatttttagtgcaaggaaaacttggtaatcagatgacaacacaattactaacgaaaccaataaacaccaagtcaacatgattcattgcatagtaaggattaaagtgaatgttattgaagctatcaactaacaaagtcaagcatacgatattgaaataacaaaaacaaaatagaaaagagagtgggaatgaccaataccttcttttgtacaaacatggagcagactctctcaattacatgaagaacagaatgcatggatgggcccacatcaagcagcaaaagcaacgcttccttttttttccataatttagttgtgacaataaaaaacaaataaaaatttatgcatttagaagtaataaaaattagaataataaaaagaaaggtgataacaaataagcaaataagcaattattttctcaaaatcagttttttaatcttgacatttggtggtgggcgtaggtggctttcatcttgtttccccaaaggtttgctgccaagtgggtttgctattaaatatttccaggttatgttctactcttggatggaatgcctattcgaaaatgtgtgccgtggaggatttgccacgttcagaaaatcaaagcttctatttttattgtataatatatataagcagcaagtgcatgctacaggaagatagttttgaggcacaaaaaagttgtactctgatatcattttagttcgggcacattctaaatggggtttcccggaaaaagtgtaaatttgaagtataattctaaacccagataactaaagttgagaaatgcaaaaggatatcaagaaatgaagtaaaaattgtaccttgtttcgagccataggtgaaaaaggaagagagagcgagatcacgctggctgaaggaggtgatttttatgttatatgtatgccgtttgttcattttatgatctttcggtcttcccgcttcaatagagaaactattcccctgctcctggacta

SEQ ID NO: 6505 - DNA, 1100 bp, Glycine max
  Soy_ogl_622 Gm02:43084101..43085200 Cluster 28
cccgagccaacacttgatcaatagatatccacttaccttcaaacacccaaatgttcctcctttgccaaattgtcgaaatgaagttttaaaaatttgccacaatttcgggttctgtctcttctaaccactgcttcagccagtcagagaatgactagacatgatcttgaatccttacccccacctcgaagcaaaccaaatcttcattgcttctacacaatctaccagggcttgactgtgaggtagtgcttgcaagccttccacattatgttcctgcaacggggaatacaagagattttccacacctttttccagaaagacctcatgtcgatctaaactccatgttgcattgtttgggcggagtctctcgaacgtcatatggtattgagaattgaccttataaaggccattttcaacatgtttccatatcatttgatcctccattgtggcaaactgatattgcaccaatagttgtagttatctcttagggaaagacagtttaaaaaaatatttagggcttaaaacgagatcattgaatttagggcttaaaacgagactatgaattaattaaatggtcaggagcatttgggatccacctatcccctcgtaccttcacatttatgccatccccgattctccaaaacgttccttggtcaataatccactttgaagccttaatacccgaccaagtggcactttggtaggaggacatttttgcattcactggctggcagcgagggaagtatttaaaagtccctgaaaaaagaaagtcaacatcgtgaaccaaacgccaccattgcttgactagaagagctaaattgaaagcccttgatgaccgaaaatccattccattcaaatcttttgattgagatcatttttcccagctagcctagtgcatctttcttctttctacatctccaccctagaaattttttgccatcattccttcaatttgcttgcataagcactaaggaagcaggaaatatcccatcatatgtgatgggatggattggaccacaaacttaatcaaaacttcacatcttgctctggataagaccttctccatccaactcttgagcttcttccaaacacaatctgggata

SEQ ID NO: 6506 - DNA, 1000 bp, Glycine max
  Soy_ogl_2 Gm02:11978601..11979600 Cluster 28
tcaaaagaataattttattttcaaaacaattttacttcactcaaatatgattacctttaataaaatatatatgtattctagaaaaaaaaattataatagttggctaacctaataagtctcacgtgagtatacagaagatcaatgatgggggcccaaaaaaggctacgagagatttgaaggtttccctcgtgaagcactcaaacaaacaactgccaatcataaaagacgttcattaggtgctaggttttagagaccacaaaataatgaactgaagtacatttcaaaaatccactttaatttcagcttgtggccaaagatgaaaagcgacaaaaatgaatccggagggtaatgttggttttgttgtacaaggaatttgcatggctagcaaaggaaaccacggagttgagtttagaacagaaactcaagtaaactcaagcaacaaagcaatatgagttattttttatactagagagatttcactataatttgctagaatgtttcattgaggtgcatgctatgaaaaaaaaaaaaggttgccgatatgctaagagcttagaccaatatttcgaacatgttatccccggataagcgattatggaatttgttgtattatttacttttcttttattgacaaatattaattattagtgaaaaaaacttgaactcatgacctttcaatttttcctttttcctataagaaccaaatcaattaagcgcaagaacactcaagtgacatctctagatgcatgctaaattcgcaccgtaaaccattttctgttacaattatatatggacccttactctcatgctattaggattctactagagtcaagatatataaacatccattgtttgcttgaggataaaattttatattttgaatttggcttttcagaattcaatggatgtgcaggaaacaggactctttgcttgaacttggtaaagttggttgaaatactttaactgtagttgtacttaaaaagggtgttaggcaggccat

SEQ ID NO: 6507 - DNA, 1200 bp, Glycine max
  Soy_ogl_602 Gm02:41893601..41894800 Cluster 28
ttgcaaagataaatagtgggcccaacctaaaaaggagagaagagatcatgctcacatatacatacaaatttagtttacacatacacacacacactaactactggacatgtgaatacgaccgtttggcatatggtattatacatgaattagtgaacaacaaaaattattcagaaaaatgattcaaaatagtatatatgattaaaatatttattcagaaaaaggtctatgcttgatcaactctatatctgcaattcaaacaaggaagaaactagtcgactcaattcaataaaaaatggttgaatttaaactctattctattttttatgaactactttttcttttaacttaataaattcacaaactgttagttctcttgagcttgcaatctcatcaacatcaagtcctggactttataaattgtcatttattactttaatcattttgtattgtgcaaaatgacagtggaaaaccaaaacaaaataatgactaattaatggataatttcttacaaagccagagactaaagggaagattttaatttgtaaaattagagactaaagggatcggtagattcgatacttcacaaacttaaggactagaacaagattttattcaaggtaatatgcataattcatacttcaatatatttaatatagatattttatactctcaaccctaagctaggttctaccctaaccaacccacacttgatccattttcggcactttctcatattctaacatctaaagagctttaagttatcatcagcattcatggtttatagttattaatgtactttaagactcagctcaaatatcaatttctcaactgcataaacgatcaacgctactattaaattgacaaaatttacacacaacattaaaaagacaattacaaaatcctcaaacacaagttcatcatctaaagctacaattattagagttcttaacccccacataacattggcccaacacatcgcataataagtaccattagcactttccacgtgacagatgacatcaattgattgatgtcgacgtaagattccaggtttaattgtcatattcaggtgggcatgttgagcgagtgagtcatcaagttctagcacaataaaaacttcaaataagtgtacataaactctgtagttaaactctgttggccatatgcttactatcattggtatctatccttttccgtgga

SEQ ID NO: 6508 - DNA, 1000 bp, Glycine max
  Soy_ogl_844 Gm03:4602301..4603300 Cluster 28
catacgatctgcgactgttatttggaccgcaacattaagattttttaactgtccacaacctcaattgagattgcatcggccacatttgtctgtgatttcccacgatatcagcaaacacaacgaaattgcaatgcaaccgctaccaatttttaaaaccttgattgtgattatagacatggtagctgaggtttaaagaagaaagaatgctactatattgtttgcctctagcttctttactggagctaaatatatatgattctgagggctaattaacttgctttatatatgattctgaattcatatggtgaagttgcaagtagacttgatggggtaggggaaaaagtgattagctttactttaagaggtcatatccaaggactttaacagggaccccccgaacaacattgtgatcaaacgaaacgtgtattgggagaggtcagattttgattctttgcagtcatgctgcttctaccttcctagcttgagcattgaatattttgtccgatccaaaaggggtatcctatcaaatgacgtagttctaggggctcaagtgattacagtttgaaacacaagtaacaatttcaatttcattgtttcaaagttctacacatactgaatagattttcatgcttaaaaaggatcaatctctacttttagtcggaaaccttggacacccaaaaaaatgttgtatatataaatatgacttgaccatgttgtgatcttttctagtacatagtttgatctacctggacaatgtgttggcaatgtcgtgtttcagggcactcctttcgactttagtgttatcatagacatgataaagtttaacatcgtgaaaatcacatgattttgtaaaactcactttttattttagttaatttcacttatgattttataaattttaaataatgctaaaaaatgtattctggtaaaaagaaataattattaaaaattatattaaaaagagtgtgttaaaagactttgttactaacactcttatatt

SEQ ID NO: 6509 - DNA, 1128 bp, Glycine max
  Soy_ogl_1630 Gm05:29413773..29414900 Cluster 28
gttaaatagattatttaacctgaaaagaaaaaaagtaatcaccctctcaattaaccggagttgcccaactcttttttttaaatcagaaaacaaatatcattaacatggtacaagaggtacccaaataaaacacactacaaaaagagaatatccaacgtgaagcaatgaggttaagctgtattaatatcaactaacataagaatacctattaatctcaagctatttgaatcagaaaattatacccacccctgacaacatatccctccttttaaaaaaaaattggtttggccagtgataaactagaatagcgttatctttgggcattacttgtgggaacgctatagctggagcaggtttacattagacgaagagcttcggcctttgagactaaagatacaacattaaaggcactaatgaggaagaactcaaaaggtccatttttttttattgttgtctatttggtttattctgtagcagtaactaaaacataagcttcaattccaataaaaattgattgcttcttatgccaagggaaacaatttctggcgatgttatgctgccagaaatcgtttaaacctctcaaagactcaaacaagtcaggcaagttaatcaccagaaaattaactcccattaaataattaaaagagttacatgtgacggtcttagtagccctcatgtgatcgtttaatggcacaaacaaatggtagggactaaaataggtgatgaaaaaataaattaacaactttgatcgatgaaacttttgtttaggaatcaattaaaaaagtttaggaattaaatacattgttaatccttagatgtatcaatttttttcttccatttttttacagacataagaaatttttttacgagtatgacaacatctttggaaatacaagaaaagtattagatacggaatggtataaatgaattttcatgaaagaactttagaaaagagaaaactataatatgaaaaaaggtttgctgacttttgccaattatttacttttgaattcttttttccccttcaagcaatgatttgctgtgaggtattgtaacaacttttgtgaccaaaaagcactgtcgggaaacgtaaaaataaaaaataactatttttgttgtaggatttat

SEQ ID NO: 6510 - DNA, 1273 bp, Glycine max
  Soy_ogl_3053 Gm09:9619266..9620538 Cluster 28
ccatccatgaatcttgttcacgtggaaggtaacatgtatcacttcaaggagaatgactccacggaggactctcaaatcaccaaggttgataaacctcctggcacggttatgatgacgacatgagccttgtggcttaaccttaatatttgctctccatgaatagcttcaaagatttaaatatggtttgttggaatattagaggtgccattaacgtgaaggggtgaagaagagtacgtgaactgatgaacatgtataaaccgtccatattcattgttttagagacacattgtgtttctgcaacatcggaaaagttctgggcattccagtgggatctgggtcctcgtggagaacaatagtaatcttcaaacacacaagaggtcaaagttttttggcaagctcttacctttcgaatcagtaaggggactcattcatggatttgttctgcagtctatgctggcccccgtctagctgaacaagtggctttattttatgggagcacttaacaactctaaggcaggaaattcgggatccttggtgcatgcttgacgattttaacgaaattgttggtccttcagaagttagatgggttccttctctttatcaagagcttccaactttatccagatgattgatgaatgtaatttggttgatctaggagctgttggcattagatatacacacttggtacaaacaacaaactgggtcctttttagcaaaaagattggatcgagttttggttgatcaaagctggcaatattgggatttttggaggcctatgtggagaacctatgtagggtttacttcgaccactgcccattgcttctccgatatggagggtgcccctcatcccgttgagatcgtcctttcaggttcgaggctacctgggctatacacaggagcttcaaacatgtggtaaggaaagcctggactgagaacattctcactctcacgagaggcctaaatgcagttagagaagatgttatcacttttaataaactatctttggtagtatttctgtctagaatcatcagtctaattatgtggggtgtaaggggttcctttttgtccctccttttgaatggatctcagtcttgatagtttcttcccctcaaggggtctttggcaagggtaccctttatcaccatatcttttcgttttatgtattgaacgattaaccctcaggaaccaagattggcttggcgtaggtaatctttgcaatttggttccctatgttcacatcatggacactaatctaaaggtgagcgatttttga

SEQ ID NO: 6511 - DNA, 1000 bp, Glycine max
  Soy_ogl_501 Gm02:11802101..11803100 Cluster 28
catttcttcttcaccacctttgggtctcaaaaatttgcatgttaattcaactattgatcatgaaagaaatggttgaacggatttttaattatgttgatgtgcgagcaattaagtttatttctttgatgaactcacaagctaatgatcttcttatttggaaccaaagtgcaactggaaattatactgtgagatccacttatcatctccttatgaaaaaaatcatttgtaacaatgctcttaaagtggaaggaaattagtctcacaagcaattaagtctattcctttgatgaactcacaagctaatgatcttcttatttggaaccaaagagcaactggaaattatattgtgagattcgcttatcatctcctgttgaaaaaaatcatttgtaacaatgctcttaaagtggaaggaaattggtctcttctttggaaacttcaaatcccacctaaggtgaagcaattcctatggaacactcttagaggttgcctcccaacaagaacacatctccagcagaaaggagtccaattcacatgcctttgtgaatattgcaaactgacattgagaatgaatgacacgttttttttttcaggttcacggtattttgagaggtggcaggcttatgggacatcatcaatcttcatatgcgaagatcagattctgcagctaacttgatcttctctttgctggaaatccttccaatggagactagaaacatatttgctatcactcttttgtgcatttggaaaatgcgaaatgagagagtttgggaatggatgagcacgcctccagcaatatccattgtgcaatgtctgcaatatcttcatgaatggtcaattattcgaaaccaagctggaaacaacacgcaacataatgttcatcaacccaaacattgatttcaattggaataaaccaccacttggctcgttcaaaataaatgtggatgcagcaattttaaagaaggaatctttggtgctggaatggttctccgtgacggaaaag

SEQ ID NO: 6512 - DNA, 1338 bp, Glycine max
  Soy_ogl_2384 Gm07:35771401..35772738 Cluster 28
cattttattcacgggcttttacatgcaagacatgaaccttgaaaaaaagaatccatttattttgcaggctagacttatccaacccatctaaaatgtaaacatatgagtgatacttttaaataggctgaacccgaatactcaacccagctaacaaatgatagtgcacctagtgtaaaccggaaatcatatgatagagtaaacccccactatccttggatgccaacaaaacgagagatcccaccagaatcttagtatatacacctagtcgtgcatacaagaggatactaagaaccaaaaatgagtaaactattcctatgttatggtaaggtcagagattaaatcccatccaccgagaaaggcatgaccacgtacgacggatgtggcactaattaaagagagattgagcagacgaggaaaaataaaacaccaagttagctattccaagatgcaaccacagtgttgaattcccactgcatacaagagaagctgaagtttagttttgctgactagctttcagccaggaccaactttggaacagtatatcatgcaggaacttatctctgttaaacaccacaccgcagaagataatgttgttcctccagttctaagtgacccaagtaacagcgcaccaaagaaccctccattttcggtttgaagcagctgaagctttgagtaaaacatgttgacagaagtgttcttgaacggatattgggtcagcagtagaaatattgagccatgagtagcatagagaccagaccgagctcgcagcatggcatctaaataggagatgggtcaacgattcctctacagatccacaaaaagagcatcaaagattcgtgttttgcactataatattccatctgatgatgtttactgcagtgggcaaagcatcccgcaaggctctccagacaaatgtgatgatctttggaagaattttcatcctccaaattagctcgaaaacctgttgattttggtcaccaaatgtaaatgcatgcagatagtcatatgctgatcggactgaatagacacccccgaattatcacccttccacccatacatcgcctacatctttggttaacctacaagaagacacgcatcgaagaaaattttggaccatgggcaattccctttcaaaccaagcccttccactcacaaaacttattcttagacaggtttaagaaactttaagaaagaccaaacttctctaattgaaaattagtttctgactcaaaattaaagattttcaaagtaattattgtagatataaaaaatgttctcctaaaaattatcatttaatttttactaattttctcgtacttatacggatattaaattcac

SEQ ID NO: 6513 - DNA, 1300 bp, Glycine max
  Soy_ogl_2401 Gm07:37726801..37728100 Cluster 28
cctattcaaatctaaaaaaatggccctagaatatcccatttgttttttgcaaatgatatgttgttatttgctaaagcaaggcctagtcaagctaggggtattgccaaggttttggaggaattttgggtgatgttggtgcttaaagttagtgtggttaaatccaaaacttttgtttcaagaatagtcacgttctgtttgagaagtgagttggatggattacccagactcagttaacgaaccagttggggaagtatctgggatttaaaatttctcaagggcgagtcacccatgataattttggtgagctggttgatagagttcattccaaattacatgcttggaagagtaggctgctgaataacccaggaagagtaaccttggttattgcagttattgccttgttaccaacatatggaatgcagattcaatggtatctatagtccatatgtgattttattgataaatccatcaggggtttcatttggtgttgccataatgataaggggttacttatggtcaagtgggagattgttataagaccaaggaagttaggtggtctaggggtgagagtggcgcatgagcagaatatagcgtggttggggaagctagtgtgggagctcttgaacccatcgaatcaattatggacatcggtgttgaagggcaagtacttccaagaaggaaatttgtttttcgctcgaaataaaaaaaaaaaaaaaggttagtggtgtggaattctattatgaaagctttggaattccttaaggaaggatttcaaatgaagattggtgagggaaatttggatttctggaatgattcatgggttacaaagaagttattggcagtgtagtttccttagattgatattcatgataccggactaagggtgaggggtgtttagtccacgaatgggttagaagttggatgatctttatacgtctcttcccttgatactggaaaaccagattaggaagatacaaccatgaatggtagaggacatgcgtggtatttgagtttagactcaaaccaagaaaaggtatattcaactaagacttcttacaagtctctcatgggggaggatgagcaaagcctgttacataatgcatgggaatagatttggaggatgcctatctcgactccaattcaattctttatctggcatgtttgtcacttagctattccaatgtggagtgttcttaagcatagacatattgtgcttatagagaactacctggtttgtaatgaggagcaggagtccataacccatttttttgtgccgttgggctagagctttatgggttct

SEQ ID NO: 6514 - DNA, 1200 bp, Glycine max
  Soy_ogl_3019 Gm09:5761201..5762400 Cluster 28
ctgtcaaggaaacattagcagagaccatggattggactccctgaaagaagggataattgttctggaaacgaatttgattgcggcagaaccaaatcacccagaaagtattaatccataaagtacacatagctatatctagttggatgttgattctcctcacaccagatctcccattggtctaggttaaagaagaacctttggttgagatatgagtgaaggagagagcattagactagccagaaaagtcttcacaagatgcacggatgggtaacagacccctttgattttcatgggctcccataatggcattaaagtccccaatgtacaacaaaggaccctggtggttgaggtgaattaaagaaaggtcgctccaaagtttatgtcgttggacatatctagtagagccataaatagccggcaagttgtaaatttgttatcaacagagatagacatagaaagatgctaattagtggaggatagaatcgaaatatcaggttttaattcaggggaacaaatacaccactggttaggagccaaagggctcctattattagttgggaaaggaatgagatgccattatctccataaatttgcaggaaaggaatcaagaagggtccaaggcttggccaagaagagcaggtcgattttgttggatacataactcctttaagacacgcctagtatccaagttggtgatgtccctagcattccaaaacatgaccttcattttcgatgagatgaagaaccacccttagcacgagtgttatgaattctactagcactaggagatgattccttttgcttcaatctttttattttgtgatttagaaagcaccactttaaagtcaaggtctgctaggggagcagtttcttccgggttcgggatttcttcatttgagcattcctctatcagatcagccaaaaatctagagaccacccttaggacattggctgcagcaactgaaactaattgaatgagatctatttcattcacctgggtgcctacaatgggagaaaaggaactggaaaaggaatccaagacatgcaattgcactacccctaagggggaaggagggagaggcctccttaatcacaggattgttcgtttgttgattttttgttgcactgcgactagagcttttcctgaagtgtcaccatgagcttccacactagaagccaacatctctcaatttaaaattg

SEQ ID NO: 6515 - DNA, 1400 bp, Glycine max
  Soy_ogl_5957 Gm18:6057701..6059100 Cluster 28
ctccttatccaatgtcttgtataagattctatccaagactttggctaaccggctccgaaaggttgttggcaaatgtatgttctaggaacaatctggcttcatccaaggaaaatccatttttgacaatgctttgatagccaacgaagtccttcatcatatgtctttttattatttctgctgaagcactttctgccttgattaaaaaagctgaagcaagtggtgatgttcatggcataaaggtcagcagaggcgctcctatagtgtctcacttcatgtatgcaaatgattgctacttgttttttagggcctctttgttggaagctggttaagtgaaaaatcttctatccctctatgaaggagcatcaagccagaagctgaatttgttgaaatttgaagctttattatgtaataccacaggtcagcaagatagaaggcaaattcttggtattagagaggggctgccaagtgggagtaaatatttgggtctccctcccttattgggagaaacaaaaaggctgattttaattatatcaaggacagactttagaagaagctaaattcttggcggggaagagttttatctggagctagaagagagattatgctaaagtcagtggctcaagttgtgcctaactatggtatgagcatctatttattcttggaatcctgggttgattcccttcaaaaaaatgatgaattcttttttgtgggggcgagaaaagggacagtaaggctattcattggttgtcgtgagataaattggctatggctaaagagtagggggggttgggcttcagaaatacccatgggtttaatcttgctcagcgaggaaaacaagattggaaccttttaaccaacccagatactattatttcaaagtttctcaaagctaaatactatctaagaagggatttcttagagactaaggtggggtacaacccatcttactctaggcgtagtatctgcgtttcgcaggtggtggtaaggaaggactttaggtggaaaattggagacgattccctcattaacatttggtctgagccgtggataaaaggtgagtgcaaacatctaaacttcctattcctgaagctgaagatctaacagttaaaagacattttgtctgaggatggaaatggttggaaagataatgttataagagtcctttttgaagaacaagtgcaggacattttaaaaatctctttaatcaaggcttttgatagaaatgagagaatctaagcttttgagaatcatggcttatactctgtgcgaaatgcttttagactcattgtggagaaaatctttgatactagctcttttagaacccctggagattggaagaactcccctccccccctgagtcaagctctttatttggggactgtgtaggaacaccataccca

SEQ ID NO: 6516 - DNA, 1708 bp, Glycine max
  Soy_ogl_5360 Gm16:28844201..28845908 Cluster 28
ttcattcaaatgtggaaagaacttatagtttgttgcagtcgcaatgacaacttggccagaatcatatctgagagacattcctataccaaaaatgccataatcattaaaaaaacacagcatcaatattgcatttaaacaacccatttgggggagctttccatcacaattgatggtgcatttaaacaacccatttgggggagctttccatcacaattgatggtgcattgtagctgaagtttcacgtggagattcacacagtctggctttcctccatttgtgtaggaattcttgagcacgatacaccaccctattcatagtagtgttcttttcgacccatattaattgattcctactacaccaaattctccacataataataatcgcaatcatagatttattttgcccagtcaactcactgtaaactgataagcaaaactgggatatgccatcactcctatccattaagcccttaactctactccaaagtcctccctctctccatactggttcaacaaaattacaacccaagagaatatgccagttgctttagaggttggtctcacaaaaagggtagataccttggcactgcattcctttggcttgtggtctttgccttcttggtagaccacctttgcacaccttgcatagaaagactttttatttctacggtgattcaagttccggatacttttccaatctccttgaacaatcagttgatccatctcagcaaaaacttctatgaaagagcgataagcagatcaaattgagtatagaccatctttactaaacctccagataggattatcctcaccttgcaagtttatcaaagggacttgtttgactactgtaacattcgctccttccatgatagaatcaattagattgctatttcaacaactagtcccccagtctatgagatctttgactaaaaaggtcaggaacatgtacattcaagctaagattagcccaaacatgttttttcatctctaaactatggatcttgccaggcctaaactcttcctccatccgctaatctccacattttaccttgcttcaccagcattcgtgaggttcaagaagagccatattaaaaaatttagtatttctaaacctcataccagcattcataatagaccacccctgctttccaagaagagccatattaaaaactttagtatttctaaacctcataccagccaagttccttccttattgccatcttgtcccatctcaaccactttatgccttctttgttgtccctcttcaaactccaccaaaaatcattcaacatactatggatatcatcaataagaccatccaataacatataaaatggcatacaatatgcatgaatcctttgtaaaaggtacttggccatcattccttacctacactagacagtcaccttcaatttcaagactaaatccttttccaaaccttatcccactcacatccaaaaattgcttttttgcttctaccaagatagaacaccaagatactttcctgtacctaggcattcagaaagtatcatagtattgatgatattgctacacacatcactaggaccattcctgttaaagaaaatctcagactttaacaggttatggcctgactcgagacaacttcatccacacataaaatgttgtgcttcacatcactttccttagggcatgctcgaaaaaataagaagcaatcatatgcaaacaac

SEQ ID NO: 6517 - DNA, 1100 bp, Glycine max
  Soy_ogl_594 Gm02:41094801..41095900 Cluster 28
agaaatgcacaacagatgcattcgcatataataatcgccatttggaattatagacaaccttatcaatatgctctttcacaccccttccttcctaagtgaacggaggccccttaaagccgagaacatgtaaactacaatcatgcaaacaacttgtaagcctttccattgaagccctattcgaacccccacctctagatttttcaaaagaatctagatacacattaaactcacccaccaccacccattgatgtctaacagtttctgcaaaaattttcatttcctcccaaagttcatgatggatagcaggtgtgggattgccatataccaaagtagccaagaactcaggattgtcatccttaggaatacaacaaatatgaacacactgagcataggggatcccagcacgtccacactccagagaaaggaatcccacataacccaaatgcctcccaaaaaaccaactgcacccactttaaacctataatccatccctagtttacaaagcacactatctgctttctgaccactaatctgagccttaaatagagccaacaagcccatatggtatttctgcaccaaatcctttatcaaccgtgaaactgttttcccacttgctccacgaatattccaagatacgaaattaaacataaaacaaatataagggaaaaagcgaaccctctaccggattcacgcacttgaagtgctaacatccatattatcatggatcctttgaacctcttcattgtgtgtaaccacatgaccatccaccccgaggggactattcatatcaacccctaattgcatagtccctcccttatccaaagtaacatccttcttactcctctgatcctcctaagagcttattcatcgcgactggattagttaggatcacttcaggctctttatccattgtcttcatacgtgcaaaaatttcttctcaagagacttcataatattgtccgcaaccaaactttctttagcaattccattctcttgaactacctcttcccttaggttttgcttacttgactcccctacttgaggcgcgcgtctagtaagagttttattttgattcttagtcaagaggctattcttggcac

SEQ ID NO: 6518 - DNA, 1000 bp, Glycine max
  Soy_ogl_5920 Gm18:3249501..3250500 Cluster 28
aaacaactttgggaactcaaagcaccatcaaaagtcaaggctttagtgtggaggataactctttctagaatcccaactagggccgacctgaaacgtagggggatcttgggtctgagtgatgttacaatctgtcctctctgtaatgagggggaggaaaatatttctcatctttttttgtgcgtgcagggttgcagctttcatttggtatcagtgtgcaaaatggtgtggcatccaaactatgattcactcaaaggtggaggagtccttctggaaattctcagggtgggttcaacggaaaaaaatgttgtatattacacagataaatccttaaggagaatataattttattcgtctcaggtttattttgtttgtgattatttataattgtaaatcgtagtttctgaataatcgatttgtggtttgtcattgatcgtgataatggatcctaaggacaacaagaaccacgtgctgtggacaaatgtttggctagcagctattaggacaatttgggatcagaggaacaatctggtgtttaatgggggacaaatattgtgtaagatggaactggtggagctgattaagtttcgagcgtggcagtggaataaagctaaagtgaaggacttgcatgcttcattgtacgagtggtcttcaaatgtaagagtagtgatgcagcagaaggatagattctgatgctgtaattcctatttcagtcttatcaatatgaagcagctgtgacgtttttatggaagaagggtgaaggttttatttggggtgatctcgccaatttggaaggtgtgaaaatccctcaattatggttatgcacgtgtacatgtgctggctggaatttgattggctaccgatgatgagctacatttgaggatgtggatggtgcataggtgttgctgcatatttattatggtcattcttaacgatggagttacaacaatcaatctcatgaagctttaatcaacggataacatgcatcaagacagggtggttg

SEQ ID NO: 6519 - DNA, 1000 bp, Glycine max
  Soy_ogl_5956 Gm18:6056601..6057600 Cluster 28
gttggcagctggattttatgggatccttgatagagctaaacgtagagattcatggaatttgtttcgcactctggcagccaatatttgcttcccctggtgcgtgatgggggacttcaacgacttactgtccaatgaagataaatgtggtagagtagagcatcctttttggttaatgcaagggtttcaagaagctgttggagattgtgggctgagagacattgtcttagaggattacccttttacttgggttaagagtaagagtattgattctgcagtggaggagcgtcttgaccgggggccatggctaatagtgattggtagtagaatttcccagaagctagattgctcaatttgtttgcttctatcttggaccatactcctattattcttcacactgaagaagaagtgtggatcagatttagaagatctttcatgtttgaaaacagttggttgaatgaaaaggagctagaagatgttgttcttggtggttggagttttaatccaaatgcagatgttattgccaagcttcaaaattgtgcttctggtttggatagctggggtcgtattttgaaatcccggttccgcgaggatattgatcgttgtaagaaggatctggagtattggagggataaaggagactcatactcggtaagtcagctttgcttgtgcaggaagttgatcagaacacttgtttctttcatgcttctgcatctgaaagaagaagaaaaaaaacaaatagattgaaggagctggctaaagaggatggttatgttgtccaaacccaagaagatttgaaaagcttagctgaggatcacttcaccaatttgtttgcaaggcagaattgtaacaatgctgatgttatttctattattcatccttgtatttctgaggaagacaattgttgtcttactactccttagtcagaaccagaattaaaggaagctttgatggatatggatccgaacaagtctccatgccctgatgggttaaatcctacttt

SEQ ID NO: 6520 - DNA, 1200 bp, Glycine max
  Soy_ogl_2115 Gm07:1389701..1390900 Cluster 29
acctctgcaacaacaataaacccgaacaaggtccccattccaccattcacccctttgctgaattagtgcattctaatttaattcactatgaattcaagtgatagatagattagatacatattccccctcttgacccaatggaaaacatgaaaaacatttcaaggttagaacaagatcaattcctatctcaaaatgatcctcttttcaccaataagagaaaaaaaaaattaggatgacaaataaatttaactataccatataagattagtcatttagattagcagacagtgagacagatttattgtaatctttgaaaatttaagaataaaattttattttatccatcttttaaagatctaacatcactatcccataaatttaacgatcaaattgagtatttaactcttgaggtgagccttttcggatttgtttggggtttggtgtacttctattgtttttgtttttctttaagaagataaaaataacattaatataaataataataacacgtgctaatcttcattttataaaatagacaattactctttcaaaagatgacacaaacacagtaacggatataataataatagtataatgacaattgcacttttaaaagactgaaaacgataaagtttaagaatggttgaagttaaaattggtcacaagtcacaacaaccgatttgacaatttcttgtgaataagctcaactcgtagtttctctttaaaataattttaaattaattgacagcataaaatattttacaataatatcacataaaaattataatcatgtactgtactatttatgtattcaatttttttaacgagtgtttaagaacaaaaggcaaagagttaaaaataaataaaaagattatcaaaaagaaaaaattgaatggtttttaggtaaattaaatgatttaataaggtatatttaattataatttttccatcgtctgtttataaacacataatagaaaattttaaatattttcataaatactaacaacacattatttaatattttaatgttatatttattattaggtaaaatttatgtcaattcaatcaaataataaattatatttattaaatcagatcctgtcttacttcatttagcactaataaaaagagacttttagtgcaaaaaactcataatggttcttagaaaatcaatatataacggttcttggaaaaccaata

SEQ ID NO: 6521 - DNA, 1591 bp, Glycine max
  Soy_ogl_5199 Gm16:242910..244500 Cluster 29
caaatgttaatgattaattgttaagagagatcaaattcatgatttttttttattcatttgttttcttacgttgtctctatgtgaagataccccactccttgggtttttttaaagaatttttttattgataatttataggataatcaaatattttaaatagaaaaataataaaaaattaattatttgatattttttcttgaaatctgaaataacagttctaactaaaataatatgtgtatcgtaaaaatgtatttaaaacagttaatttgaatgcgctaattttttttaaaaaaaaataattcattctactatctattatatacaatagatcagtgtgacataactacaattccctcgattgaagtctgcattgacaaattaaaacaaaaccaatttaacgtacatcatctcatgactaagagaagaggaattaattaatttaagacccaacataatggctactgctgcgttcaatttgctgattcaaagtgttcatggtttgataaagattattcttgtttccccgcagctgttccatattttagggttatgcatgcaaagacatttttgaaacaccacaccaaaaaacaaaagttgggtgtgttctaccaatttcatgatatattttccacccaatagaatgcatattagaaatagagaggagcagcgcaacagttttcaataatcaaaatatataagtatggcaatttggagaacttggagggacgtaactggtcagagaaggattccatttaatttataatatatattttattttttttatcaatccaaatgagtatagatttttttttttttttatcttttcttcttctaatttcaattcaaacaatttaatatttcactgttttgtaatgtacgttctatttttcatctttaattccatcttggataagtatattaattccatcttggataagtatattaatatattttagtgtcagcatacatttaaatcttaggaaaaaaaaaataatactaattgtcctacaccagcgagatggaattaatatacttatccaagatggaattaatgatttcacacacaagcacggatctaagagggataagcagggccttgccgtcccccttatacacacatttataaacttgatatatttaacaaatttttccaatcaaataatttggttaataaaagttaccatttgaaggttattaattgtctcgttagaattattattgacattgacaagttattaacgttgttgtttttgtcatctattaatattattacttgatagtactaactaaaagtgataatgaaaaaaaaaatccagggactttggacaactgaaatttagattaaaagctaaaaacataaattcaaaaaagtttagggaaaaaaggaaaattagtttaaaagtggtaaatgaaaagtccagggactttgcacggttgaagtttagattaaaaactaaaagcatagattcgaaaaaatttaggacccgaaaaataggaaattttttagggcttgttcgagagaatattaataaaattataaaactgtagtagcacaagcagactagaagtgaaataatgattgtacacaacg

SEQ ID NO: 6522 - DNA, 1100 bp, Glycine max
  Soy_ogl_2525 Gm08:6062301..6063400 Cluster 29
aaattttcttatatttaaatatttaaaaataaacacataaatttattaaaaatatattttttatttcattaaacaaataacataatttaacgaatatgaaaacaaacatcatattttttcttaaataacatttttatttaatttactcttatgttatgaattactattaaaaaatttatctttaagaaaaattttcatatacataagcatcaattataattaggcatgactaagggacatggcagggtgcagattttactcccctgaccctgtcattctcgcaaaaagttaccaaacatatgatttaaaagatgttatattatagtttttaactcattagcatgtacccttctaccgaattttatttagtttgtgtaaactcgtacggattttctctcattttaaaattttaattgattaattatatttattatttaatttattttttacatttgattccaaaaaggaaattctctaattctctatcattttcatctatattaataaaatatcattttatattaaaatttaaatatattttattctttattaatatactaagtttagtcttatattctttctaatttaatttttgtttgtgtttttttaatatgttaatatatcatacaattaaaaatccatacaatatgaatttatgattataacacattaggaaaattaagtaaaagagtgatattttttaataagtgtcacattttaatttggataaaaaaaagatataaaataaaaaaataactaatttatttataaaaataatatagaataattttaaaaagatatattacaaaactatattttttttaaaaatggcccctttcaattgtgaactcaatgcggtcgcacctccacatgaccccctaatagagaaaacttgctagctttctctaaactgacagtcatacttccttttgagaaatgtttcaatatgaatttttctttaattagaagcctcggaggcttaaattgggaaggaaaaaattgtagttattcactccaacacttttcactttccaattggcacgattcaaaaaaaaattgcaaaaaaaatcataccaatattcaagttataacaagataga

SEQ ID NO: 6523 - DNA, 1260 bp, Glycine max
  Soy_ogl_1512 Gm05:1311618..1312877 Cluster 29
gtaagaatgatcattgaccctcgcactaacctacataacaaacaatatcatttagtcaaaaatcaactttttattatcacagaacaaactcatgccatagtgccattgctttggtctgtgaaaaacttggaccgaaattatgtctagcgaaggttattcaccgtggaataattgttgcagggcttaaaaatctacaaaagctaaacttagtccaactccaaccaccaaataccaaccatttaaatggcgtgaagaataatataggtgcatgaaaactaataaaaagccactatacaatttatgcatcagggcaataaattagaaaattgaagttgcgatttttcaaaagcaatcatattaggtgtatgtcagatatgaagtacatcagtataatattttccaatatgtactaccaaaaaagtatagactgaatttcaatatgtaccaaaaaaaaataatattagatgtatgtcacatatggagcataatatttttcggatcaaacaagtgatattttttattcataaataagttgtattatcttatgcttatcttatttaaaatttaaactttttaaaaatatatttgttttactatttaaaaaattacagcaatagtgaataatgtaatgaaaatgacaaaaaatacacaaatcattatggataatagatagagactactagattgtaggtactaacattcaattatatgtgtcgttagcatgcttaattatttagctctttgatgcttatatacctaacgtcgtgttacgactgtattgcatgaagagggtggatcagtgtacagtacacaaatgtcttgttaaatcaataatctatctatcctcagatattacatcagtagtcgactgttattaatggcataggcaatttctcatacctgtgaacaatgattgaagtcgtggcctcttcttatttggtgtttgtaattctagtcaaggattgtgtaactattttgtatataaagccatcgatataagggttatataatatataaaatcatgtaattggtggtgtaaaatgttttttttcgtgcattgttgatatgtaattctagtcaaggattaaaaattatcatcaggaaatattcaaaactttatacttaaatttgcaaaattattacgagagcccacttaacataggtaagcaccacgtcatatattcatctttgccctaaaaaaagatgattgattatattgaatttaatagacacgtgttttgcttagtaaaattttacgcg

SEQ ID NO: 6524 - DNA, 1207 bp, Glycine max
  Soy_ogl_6305 Gm19:362794..364000 Cluster 29
acatatcatagatagaaaaaaactattaaaaataaaatattttataaaaaaacaattaaatgtccttatttacagaatcatattcagagccccaaagagaaataccaaataaaaatagttacttaatctgcatttcaaaattaacttttataatttataatttaaaaataaaaattggggcgacatgcatttggaataacaaatagatccatcgtgtaatacattctctaatttaaaaacaaggatatccttactttccagatcaacaagctgggagcaagcgtgtaatacattctctaaattggtgataataaaggaagctagtatgaaaaattataatcattttttttatttcaagtgagttttatttcatacctttttaatcttttctttcttttctattatatttatcactttggttctctatctttttttcctctctattccaaatttccaatcgacctaaaaatagggttgacattaataaacactcgaaattatttttttagcaaaaataataactataaaaagataaagacaaagataaagtgacaaatataataaataatgagtatgatagaaataaagagaaaatgaaaaaaaaatataatgaatcgaaataataaacaaataataactcaccataaaaaacttggtgacccaagtcgtcaacttggaggccgtatgtcgatactttgaattttcttcactgtttttttttttttaattattgctttgttaatattaagggtcttttctcttgattgattcaagcctttttcttgattgatgtagataagatctgatgtattctttcatttttttttttatcgttatacatcatttttattctttggttcctttgctgaaatgttacgtccatcctagccttttcttaattaatctctggtttttgtttaggacatctgaattttgataactgaataattttgaagtcatttgcatttgttaatttgccaaaaatatatttccaactaagattgtacaacaaaaggaagttaatttaggtgtgacgtctcattaattttgtagttttaatttagaacattgagtagttataatagcttggtgatatttaatagcttttaataaattaatataatcattatcattactattttcttttttttatcagccaataaaaaactttcattagataactaggtatagtacaagaggtaccagc

SEQ ID NO: 6525 - DNA, 1385 bp, Glycine max
  Soy_ogl_2514 Gm08:5042101..5043485 Cluster 29
aaattaagaacacatataaatcttataactatatctttataaaagcaattggagaatagaaatataaattaactaaactagtattctttttattttttggtagagaaactagtaatctttaaatattcaagtttaattctttatgtctaaaacaaaaaaaattatgtaaggtttattaatatatataatatttaattttatgtacagtaaaaaactattctatatatacaaacaaatcacgaatgtctaaaagttttcacgtcccaaaccaattcaagaaacctatttactttggagctgatgatttagattgtttccttgcatttcacttcagtacgaaagtaggtccagaaagattgctgctcttcatagtttagttaaaattaaaatgctgttatcatgaatctaggacctttaaccgaactctaactcacagctttgatctctctaaagcgtgctaatctcagattttcaaacacagtaagatttgcgtaagttctaagattttcaggcgtgacaattttctgaacctagaaaatctctaggttgcagtttcaattagttagcctttttttaaataaaaaaatgtgatgataacattattttcgattagatggccagccaagttatatgtgcctcaaatcatgatgaagatttatcataaattagaggagctacttttggggcgtgaatgtgcccactgtctacgtttttctgagcttatgcacgtgttagtcaaagtattcctgtctgtgtaatcttgttccatgattctgttagggttactttttaaaatccttttgaatgaatatcttcaattccaagttggaggctcgatcagtctcaagctcccattgaaatggagaaaagttcgggggctataattaagaaagaggaatgaacttccttcaattcgtggtgtactaatctcaaagtttattgagatccatgaagaaaatgatcatatatatcttattgagttgacttcaagttcaaggtctaaaagatctttgatcagatgaatttctccttatttactagattttcaatggttttttacacgagatatgtttttaattaagaagaaatcgtagcttagtgtttttataagaataattttttattatatggaaatttgagctagctgagtacgtggatgcctgtggcattctttcttcttccgtcaataaatgaaaattttcacaagttttcttcttcctcctgggctatactaagtcagaataactaattaacaggaatttttttctgtatatagtatatatgtgactgaaatgtatggcagcgacttctaatatttgtaagtattacttcttagggtaaaccgttataaatatttaatgcgatagcgtatatagtctgcgttg

SEQ ID NO: 6526 - DNA, 1400 bp, Glycine max
  Soy_ogl_3986 Gm12:3050101..3051500 Cluster 29
aaagttctttgtttttagaataaatatcaaattgttttgtcaatattatgttatttgacagctacatgagttggatcgtgaaattcagtttgtcatttactttcaaaatggaactgaaccattttaaaccgttaaatcaattaaaaataagaatgaattaaattgctaattacaacattcatatttttttatatcggtttattttaattttttattctattgttaaaattgaactaaactaaactgaattgcattttagattgtttttcttattacattatgttccacataaaattagtgtttttttctcttgatggattgtattaggtatgtacgtaaattatggattcaatcatgtgtgatctttttttgttgaagatatgtgatcttttgttgatcgatctattgattatagttatgcatatttaatcagaattgaagtgattgttaaattatgtagtgtatctgtttatttagtagttgtcaaattaaacacatttttttaaaaaaatataacaaattgaaaaatctaaatactatttcagaaaacaaagaaaatttgtttaatttgattcaaatttgatattgcattcaaaccaaacaaagacaaatcacgttatttttatatttgattgaaatgagatctttttatttaaaaatcaaactaaacgaattgcgaaaaccctatccattttgtccttattacttcatgcacggtctacattaagaaaatataagtttacaattccatttttattttattttggttgccagtttacgatacatctcgtgcacatccaaagtgatattaaaataaaatcaagtaaaaaaaataaagcctatcaaatttaataggaacctgaaaattcagcgagaatggcccgcaaaaaacacaagacgagaataattattctctcttatttattcataataagatatttataatatccattaaaaaaatttaagccaacaacttattttgttatactttacggattttttgtggttctccttctccttctcttttttttttttatcaaaagttctccttctcctatgaaccgtattattcagaaaaatgtaaagtacagttagtacatcaaacagtatagatgatattttcaattatacatgcgtttttaaatatttgcaataatttatatcaaacattaaaaaacagtgattaacaaatgaagaaaacaaatcatagttaggataaaaggaaaaggaaaaacataaaatgattataaataggtgtagatcagataaacacaaagcagagttaggtactatgggaatagtttattctcatttgtcaattatgtttggatcgtagctaaacgtactctttatgagtttatgggttagctaaaacgtactgtctcctcccaatatatttt

SEQ ID NO: 6527 - DNA, 1038 bp, Glycine max
  Soy_ogl_5509 Gm17:4550101..4551138 Cluster 29
taagatgagaagagtgcatcaactagcttcacatcatcaattatcctgaataaataaagaataaaaaacaactaatcatagtaaattgtacataactacttcattagattattaatgacatagtaagtcattggattatcctgaataaataaagaataaaacttttttagtaaacaaaaaatactgggaccaaaaacactaaaaaaaatgtctaaggataaaaaataaaaaaactcaaaaagtttacggaacacaaaaatattatacccaaactttatttattattagtagaatgagtgatagaaaaattctaaacgaggatttaacattgttcaaaaagtaaatattgaatgacttttataatttttttatagactcatgctaattaaatgtttttaaaatactattttcattcttaaattatggttgtttaaggtttttatacacaaattaagaaaaatttaaactatataaattgaaaaaatattatcgttttctattttacaaatttctatattattttcaactactctatttatagcttagtactccaatttataattgtacctctaaattagacattgatgggatagtgttcttttacaatgcaaatgatactgagtaatttttttttatacaagtacactaagaagtagtattaatactccactttatatactataccttttgaagatcaaagttagtaatttatctttttaattatttattatatgtaagggtataattgtaaaaagtgaacaacattatgtcttaattgaaattctaaagtaatcaaagtttttttttcttagttagatataactcccatggataacaaaatttctctaagtaataacgcagtcgtatactcatgacatgaatttgagattactatacgtgattaagtaatcaaagttttgaaataataaaatactaggacaaccaaaatttaagaatgaaggagtgctaaaggaggagtaataaataaaacattttcattggaatctcaataagtttattggaaatgagggaaacttc

SEQ ID NO: 6528 - DNA, 1183 bp, Glycine max
  Soy_ogl_4 Gm01:325901..327083 Cluster 29
atatataaattatatatattcttcccatatttcctgaccaaattaattaagctcgatccctaccattcacatgttggacacatgcatggatttcgatatatttaggcaaccaccaacaatataattaacaaacaagctccgttaattgatatcatgatggacagtggattcaaacttcaaaagctttaaatcttattctatttataagtttatatatgtatccatcatatccaattagatatttttaggtaacttgtctcttgcatgcatgtttggaaattttctaggacatacaataaaagatgagaattcccgaataattggtagagtgtccacatcggatatggtagaaagaattacttacaggtttcttcttatagtcccatcagatatggtagaaagaattacttacaggtttcttatagtcctacaaaataatagcagacactatctatatattaaagtaatttatttttggcaaaagtagtcttaacaaaaatggttatcgcctcattaagtgcacgtcttgatttccttgatttttaataattaatttttttaaagttttctaatgaaatattgacaataagttatttttataaataacataaatttgaagcgcgcactaaattatagtatacaatatttatcttgtgatataaccctttttttaaataaaaaaacaaaaacaaaaacactaaatacacattgtagatttagaaagaggaaaattagaaaaggcataaactgaaattatgaataccagcctataattttttaatgaaaaattaaagacattatccctcattgctacttatatatacatcactctttagcatgtgtttgtttattcgttcaagacatttacctataaggaacaattcttttctcacgttttctctcattagaatgtaaaactactgatgataaatggttgattcaaattatggctgctgttcacatttagcgtttaattttgtctcaatcaaacatgattgtatcctaaagaagatatttttaaagaaataaaaaaaattgtttgtttatctcatataaaacttggtttctaatatgagaattgatgtaaattccacgtgatacttagattagagattttcataaaatcaagtagaattttattttcttgaattaattaaaatagaattaaaaaaatgttcatact

SEQ ID NO: 6529 - DNA, 1448 bp, Glycine max
  Soy_ogl_1105 Gm03:45737700..45739147 Cluster 29
cgatagcattgtaaagcaaacttacactgttaatatgtatagcttttttctccgaaatttataattctgatattttttattatttgatagtatctttacactgaagatacaatttttaaactcataaataatattcttccttattacgcacaaaaagaaaatattcttccttatataaaaaggaaatattaatgttacttactactttaagaaaagtttgatgttatgacttcatgcaataaagttgacagatgagttattaattgggacatctaagttccatttacactgtaagattaacaaccaacatacaatattacacgtacattagcaagtttaatgacatttaatttgggaagcttatctttggtggctttctgattcttcaagagtcaattatgttatcaaacttaattgtaaatgtgtgattgtgaaggcaaactgatctgagagttcctgaaccgtagagattataaatctctctgcccgggtacctaataaggtgcaaaactatgcaacttttttcatcatatcctgcttactaattaaattccaaactcgatgttttgtggttaaacgttttacacacaacaacttttgattaatttccattcatgttgtatgtcagaagccattataatttttgcttggacgaattttacttgcaatctgtatcgtcggtcttcaattttctctatgtcactgtcatctcttctgcgggctagctggccataactgataactttacttattggccaagtcataaaatcattcagagcgttcccacttcccattttcttcatgttgcgtgtgggaattgacatatatatatatagtgttaaattttcatcttcgtctctgttagctttaaacggtcgctaattaaatcaaataaaagtataagaataggaggacacattatggaaagctctctataaagtagaaaggacacctaactccaacaaaatattatggaaaactcactataaaacaatatgcaacgaaataaagtcccaagcaagaacctgcaggccaataagaataaatatattgcaattaagtggtatatttattcttattgtaaaaagacaatatgaaattatttttaaaaaaacttaattgctcttttgattatacaagtattgcagttggaattttgagaactaaaattgcacaattctttgcaaatgcattgtttatgggggagtctccaacatctctattaagtattcaagcataaatctgacttttttactttccttttgggtcaattaaagattacttacggctctagcccggaaatgtttcctcagccaccgatggaattgaggttatataatcctcatatattccaatgaatgaccaccatacgagtttctttatcaggtacttagaaaattaaaataaaaaatatattaaaagaataatatctaagctcgtcttataaa

SEQ ID NO: 6530 - DNA, 1127 bp, Glycine max
  Soy_ogl_3626 Gm10:48603401..48604527 Cluster 29
gtaaataatgagtgtcatattaattgtcacgcaccatgtacaagttctcaatgacattttgtgataataatataaaaagtgacaaattgtatacgtataccatataacttgtaactattacgacttatctatctaggcacaaaattaaactcaaaatgaattatatggttcatgaaaatctattgaggaaattcaaagtacttttttgaacaattaatttccacacaatgtcaggttcttgaagcaaatggagaaagaaaccatgaggataatgagggcaagttaaaaggtaagagaacaattgatgacctcacaatggcagattccttgacaacaacacaatgtcaggttcttacagaaaatggagaaagaaaccatgatgacaatgcaggcatgctaagagagaagggaacaattgatggaaatgctatgccagattcaggggaatcaactcctatgagctcttacaactatcattatcactgtttatttgatgagagaaaacgctcaattgtttggactcctgagttgcacttaaagttcacagaagccatgcatatgataggagagaatagtactattacttttccctctcactcaccatatattgaatgggtttaagcttcattcttaataagttaagtagtaattactaattcactatctttgattgacttccttttcatatccagcggctcgtcctaaacaaatactaagtttgatgaatgagccttacctcactgttcgccaggttgcaagtcatctacaggttattttctgtcactttaacttaaacaagcaataggttctcataatttatattgcacaaattaatgttttaaagttttaaattgtgtgtgtggttatgttttgttgcaatcttaatattgtaaaaaattatagttgaagtggttgaagtttcccaaaagctttgatgctacaattgtagttgcaaacttgtccgtttgatgaccaatatatgatagtataagataattattatgtaaaaaaatatataatttttagcaaaacaataatttgttgacattcaaatataatttatgttatatcgtatcattatttgatttatcacctgatgcatatcaaacattaaatatgattaaagc

SEQ ID NO: 6531 - DNA, 1083 bp, Glycine max
  Soy_ogl_1813 Gm06:6708318..6709400 Cluster 29
atttaacaaaaaaataaaatttaagttattttaaaaatttatttagttaaatagattatgttacacatcttaagaaaaaacttattaaatctgaggaaccaacccgtttaatgataatgttttataataaaaatattattattaatatgttataattattttatttaaattagaaaattattttaataaattaatgattgaaatcattttaattaatatttaaaatatgttaattcatacaaagtatagatagataataagaatatgaactattttctttttcatgagacgtaaaaacttttgttaacatgtaatgggatgcagcggggatgatatattgcttattcagattttgactggactttttatcttttctcaactgcattataaaacaactcctggtggaattgaatgacaagggtgggctcaccttcctcgttatgttgcccatttgtgtccattaggcaattagcatagcgtgaggtagctatatcgatttaaagctgaaaattgcctgtatatgattataaagcatttcacaattttgaatctctcggattccatttcaagaaaacgttgagtggctataaatgattaaaaactcaagcacttctatgatattgatatccctatttgatatgctttctaaatttatatatctagttcctacaaaagaatttgacacttgatatacccttctaagtatgtttcttttcctaaagctatccttacacagcgtccttatcaagcatcatgaaattgaaagatgaagagtagagtctgtaaaaaaaaagaggtgaagagtagagactttgagagcgatatgtgtcacattcattgattccatttcttaccttccgctaattcctttcccctttgagtccattcttctggtcaaatttatgaaaactactctcaatatttcactgcatgttttaacattttctatatatgaaccatgacaacttgtttcatcatcagtacttaggacttaatttctctccttccgttgcaatggtttgtttcttacatctacaaagcaaaatttaacttgcgctatacagcttattgattgaaattata

SEQ ID NO: 6532 - DNA, 1100 bp, Glycine max
  Soy_ogl_1123 Gm03:47145101..47146200 Cluster 29
gtaacatgtaaataaagctaggcttgataaaggcaattcatagaaatcgtactaatccattcatgcagaactaatattaatcaaattgaaagaaaaaaaaaacacaaacacaagaacctaaattttcaccgtatgtaaaattatgttgaactaacaataattacacattacaagtgatattaattttttgattaaatgagtaagaaaatatctatgatttttgacataggataatttttttttcattcttataatcccattaccctttggcacaatagaataatagttagtttttttatctcaggtttttaagttttttctttttatatgaaccatgtgttaaacttatattagattcaatttcaaaaaacaaaataaaaacttaaatattcaaaatatgtacttctcttctaatatgatttatttcatattattactactagttgtttccgctgttgttggtaggatgttatatatggaagttaaatcttagtttatgtaactttaatttttcttttcatttactaatgctaaggacaaaattcaaatcacaaccatatcttcttttttctttatttgtttatttattattaagcaaccgtatcttcttctttataggaatcgtatccaattactgtataactttgaacaactatataatctatcgtggaagtatcgttttcagcatcagtttatgtttagcctagattttgtgcttgtcgatctttggataaggcatatattattgggggctgtggggctccatttgtgtggtatactattcatcacttaattgcactttattttatgcactgtttgtaagatagaagagaaatagggtaaataaaaataagtaagaaatactataaaaatgaaagatttttcgtatttttacttgctttgacacagctgtcttgcgcgggtaataacttttgttatagaggtcggattgtatgattcaggtgttgttggaaagataagacagagcaatacattttagtttctcacaagctcaggcctattctgattattttgaggtaataaacgagcttcaacttgctgcttttgcactttgatttttctagctttttattatttgg

SEQ ID NO: 6533 - DNA, 1017 bp, Glycine max
  Soy_ogl_327 Gm02:2463001..2464017 Cluster 29
aaagatctgggatacggcgtcgtatcaaacaggccaacataagattgaattagcaagatgatatatattagggattcattacttctatcgcacctaactagatgttcctcaaacagcatgaataacagtaaaccaattgatacaatatatatatagtaaagcctaaagatgcatcagtggcgcatgataattgttagattctttttatttagatgaatttctattattttttatttttatttaaatattttagcatacagatttaaatatataattatgatataaaaatcctttttaatttcttaatataacgttgagtttttttaatctattatccccatattattctttttgtacattgcgaaagtaacatgacattattaaagaatcaaagtaaaaagtttttatttgaaattattattaatgcatttttaccatgaatttcaatgcatcccaagataattaatttctaaatcagaggaaaaattccatccttcttctttatataaagaataaattaagttaacaaattgctaccatttggcactaccgaaatgtatcgaccaatttatcgagatattaggatcccttttaaaaattggaacttttattataattaaagaaaaaatgtcctgggtcatgaatgattgcttaatgtataatgttaaatccgaggaaaaaccatgcttcttctttatataagaaataaagttttcaaagtgctaatttgaccatttggcactaacaaaatgcatccccatcgaacttcctgatttctaattcctaacgaacgtaagacatgatgcttaattgtagccaaaaaaactaaagcaaacaactttgaaattctcggccttttaaatgacgtcgtgtgtgtgtgtctatatatatattgctgaataaatgacgacgacgtatatgattccacctaatttagcaaatgataggaatcacaaaaatattaatttatttggagtattaaattattgtaaaatggagtatactttaatttaaata

SEQ ID NO: 6534 - DNA, 1000 bp, Glycine max
  Soy_ogl_1027 Gm03:41825901..41826900 Cluster 29
atggccacataactttatgatagctcagccccacttttatcatctcatgattacgaattattacatcacacccaaaatgtcggtaattattattcttcaattctcttgcagttatctactatgttttttcttggcacgactatcccttaatttcttaaataagatattaatcttatttgtaatattgtaattgtcgctcactctgaggattttttcaaataacaaacattaaatacaagatttcctgttaaataaatcgtcattacaatatttaagcgcggtgtgtttagccactatcccaattagttagattaatttctttccacgtttggttgattaatttgttataacgtttgttccggttggataattacgtggattttttaatttctatggcggcaaccgactggccatccacaccctcctttcctccatttagtaattttgattgtttgagcaagttgattacttaactctttatttggttttcatgttataataaagtctgaaaaaacaatagaagccacttctcttggtctcaattttattttatattgtttatatgagtttttatttatttttgggtcctttgcaatagcaatgctgacgtaccatttctagggtccagcccacgtttgacgtcgcaacatgaatttgtattgtgttggatggctgctctgagacctatacgatctattatgtattggtggatttcttatcaaatctcaaccacataattagtcaaaagcacgcatggaaggaaattaaataatgcagaaaacgttaaagaatatataattatgcatatgtgtattgcgcttacattttagaaaattgtctctatcaaaatgaataagtatttcatttatttatcgactaatgtaaaataaatctatgctagtatataattttattagatctacacgttttattagataattaaattctttaactgctctcaaaagttcaaactatttattgtcttttaaactacactaac

SEQ ID NO: 6535 - DNA, 1216 bp, Glycine max
  Soy_ogl_2476 Gm08:2782701..2783916 Cluster 29
ttggatatgtcaatttggatctttgatgctctcaaaatgctagagaagttaattataatagttgactttaacaaatactcacttttatgagtcatttgacacttttcaaatagactattcattttttttataatagtgttattgaagttagaaattatgattgcatgcatattattgtgctgtactagtaataattaggctaataagggtagactttaaatattgaaatgcatatgaaactacttttatgtcggaaagctattaatgtatcatgtagtttgtgcttaaggactcacgggagttggttacagtagtaactacctcaacaaagagaacgactcatagcctgtttgtattcattcggaaaatggagtttcttcaccacaattttttaagctttggttccaaaatcgtgttattttggcttgaaaagtcacatttttttttttcgtttgactcgggttctcaacagtttttgccctatttaactggacttcggaagaaaaggtcgagaatagagaatgtgaaatatattacttttttcttttacaagagattactttttccagtgtgaaagtgaaagtgaaactactattattaaccctaaaaaaaaaaaactactattactagagtctagagttaccattgatataaaatggaccgtgccttttggagtacttgtgagttatgacaatgacattgacatggatgggagtttgaaacatttaattttgaaccattgtagctttgttttttttttttttttgaagtgaataaaaaatgagtgtatatttataattatctctttaaaatataaaaatcattaaattaaattgtattcttctaaagaagtactgttttactatactcataaaggagaaaaactgctgaatggttatcatcaataactgcctagggggtctatcaagcaaatgtaaaaaacccatctatgacaacatcttcttattcttcttcttttttattttattttgaggtatattgttttgtaagtgattgaaaattatctatagatgttagttggtaaatcaattattgttacaatacggaaaacatgttgggctagctctgctgcataattctatttttttaaaagaagtcattcaatgatagtttctaatgtactgtttgattcaaattatgagagggaaagcaattttagttaaagagaagaagagggaacgagttttttcaaaag

SEQ ID NO: 6536 - DNA, 1000 bp, Glycine max
  Soy_ogl_3756 Gm11:5706301..5707300 Cluster 29
gaagatgtatattcacatttagtatgggacagtgtctagagaaaagattgtccttgaaaaatgacatatgttaaaaccaaacaaaataagaaagaaaaaaatctaatgagtaaaaataatatttcatcaaaagtgcattaatgtgatttttggaattcacttttttatatttttaattaatacttgttttattttagaaaatttcatccttctatacctttcagttcgtgaatttaattagtgcattccgttcttcggaacaaattactaatagcatcatggaataaagcaatagaatcatcaaatcttcttactcgtttttgcatatatgtatagaatctttttagttacttaactatcaaaatgtctttataaatactctcaccgttcaccaccgttgacaatcaacagaaatagcaatgcaagataaggacacaagttatgtctgaaatctaatatttcaaatgtcaggaaagatcaatatctcaaacctattgtttatgatttaataatttatatttttttttataaactatagaataatacaaatactgttttggtacaaaagttagctacatgaaatttcgtgtgaaaattgagaacaacataagaacagaaatgacaaccgatataatcatacaaaatttcattaatcaacatgaaaaaatacggactcgatctaacccaacgatgacatggttttggtcttttggacgagacatgaagaagacatatggatatggaggcttcgattgaaagtagtgcggctgcagaaaataatagtgtgaacatgacaaaattattacttcacatgcaaaaaaaaaaaagagtaatgaagaacgttaaaaaataaatgatacttaaatggtaacttaaagttataaaataattgaaaattgtggtgctctcccacattgctcaatgtaggtatgctggtgaaagaatggtcaatactcctaaattagacaaaaacaaagtcagagattggaaggcaatagga

SEQ ID NO: 6537 - DNA, 1038 bp, Glycine max
  Soy_ogl_5207 Gm16:546963..548000 Cluster 29
tactttaaaaaatcattatatttttgtactaaaagcagaaaaaatatgaaatactttttttttttttaacacaatacagttttttacttttatttaaaaatatatttttatttattaataaataatttaagaatatccactaatgattgtctttgacgttgttgactcgtgttcatattttgttttaaaaaaaagtgaagtttaagatgatatattatttaaaatttgagtcgtatccattaacgacactatttttttttctttttaatactctttagcatcaattcaaggcgaagaatattcaaagcaaattcgagaaaatcatatgatctcttgcaagcaaactctagtaggataactacacgtttaagtcaatgtcagtaggaataaataaagtgtgtagagttgttaatcttagtcttgttatgtttacttataaggctcttattgatgtgaagtagagtctcttgtgtgatgatgcgtgaggtgtcgctgagaccaatcttctaacttgcattgcttattattaacaaattgtgttcattatctcatgcttcgcacctggaagtcttgtgttcatggaggaaaattctcgagccatgctttaggctatatcaaatacttaggcttgatgaaattaggtcaacgtttatgctttatttatgtgagcttaggtatatttaacagagtctaaaacaaatactatataatatattaagtaataagataagtgtttttttataaggtggacaacattataatgatactacatgttgtcattttccttttcctcgtggtttgaaagttaaggtatcaagggtgtgtttagtttaatattaggctgaacgagtacacatttttatacatattttgtgggggaaaaaaaataaaatttggagcttttgattcaatgatcgtttgggaatctcctaacgataaatcaaacacacaagtagttagtttgctacaaatatttattaattacaataatctctatctatgaagcatctaaacactctcattatatctttttcattc

SEQ ID NO: 6538 - DNA, 1200 bp, Glycine max
  Soy_ogl_6196 Gm18:56211601..56212800 Cluster 29
aagctttttgccaaatttacaagtgtcaaagttcctacaaagcttttgtacaaatataggttctttagactgttaaaatataggaaaagcaaaatctttcaccttagcactcaaccatgacaaagatctaagtttaattaaaattaggacatactctacatttgacacatagttttttaagacaatattatttctatgcaaccataaagttcgtactgatcgagtgaaatcagccaacccaccataattttataagcagaaatgttgtagaaaatgattcctatatataatcttttgttatcattacttgaacccctaaccacttgtagcattctttccaagcaagtggagagaaagagaataaaaacagaggatgagatgtacactcctcctcttgacaacagaacggtgtaatatgttatgtctctagctagtatttatagaacgaattatcaaaacgttatgaataataaaaatggtcagataagaggataatcgtaaaattagttttcattagtcattaacaaaatcattatttttatctaaatgtatcttttgaacaagtatgaatcgatgaaataatgccaatttcattcttcacaccataagccaacgtaaccgtataaaaccaaatggtcaaattagttaaaatttatattcgatactaaaagaaatatatgttaacaattttttatcctttatacatcatatgtatgcataggttaaggaaataaaaatatagtttttaacacaaattatttgatattattttttaaaataattgagaataaagtatatatatatacactttgatcctcaaatgtgcaactcaaaatgcagatataccttcggtacaatgtctagctaccacaaaagcttggcgtatttattgacatgcatgtctcataactacacgtgctccatgaaaaataaagtgctactttgcaatctagctaacttatattcatttatagctactttgtgacttttaaaatttggtgtggttcccttgtgttctcttcacttcaatgttgaatattatgaaatatctctttctagttagaaacatggatcactttcggaagcaagtgatctccttatgctttgttctcttgtatgatacataatctactgttctgcaaattttcttattatgtgtagaatttctagataattgttaaactatagtgtggtcttaaa

SEQ ID NO: 6539 - DNA, 1014 bp, Glycine max
  Soy_ogl_765 Gm02:51196301..51197314 Cluster 29
ttatcttttgaatctatagaccaaacaaaagttcctaatgacatgtgaattgtgattagcatatatgaaatgaatatcatcttttcacctagcaaaaaatatcatcctttcgtattacaagaaagtcaactagacaattgcaagggaacgttcgtatgatatatgtcacattttttttctcaaaaaagctaaaatattttttttttatccttgatattttttattaattatattcagttagattagttgagtttcataaagcaaggaaatttaatgcatatcttgtatctttgccatattttattttattttcacaagataaccgaaaaacggctcaagtgaaaatattgtaattatttgggaaaacaaaaaataatgaatatgtatcactaagtcttatctaaatggttaaagattaaaaaataaatatatccttttaaatggtcatgtaactattaacatttgatttattttatcttaattgtttttgtatggtggtatgatcaatatttataattctcatattttaaatatatataaatttgttctcgttatatatatcccaaataatataatgaaaaaacgaggcagttaaaacatattatttaaatcacttcattttttgttttaaaaaaatcacttcatttttttcaataggggaaaatatcattttattttattttgagtaaatgaaaaaatttattttatcttaaaaaatcatttttatttgggagcgaacgaatttggattaaattcctttttattatatagttcaaaaacttgtaatgtctccagcataagaaaataatacttgctgatgtttttgggttttcttaatttatgtctcacttttttctttgttagaattttattttatgtctctcctagtgatgctaataaaggaatgaaaaaggaaaaaaagaagaagaggtaatgggtattgaaagctggaaattgagaagaaataatgtttttataatttaactagcattttaacttacatacactgtactc

SEQ ID NO: 6540 - DNA, 1000 bp, Glycine max
  Soy_ogl_1124 Gm03:47228701..472130 Cluster 29
tcttgacgcaactcaaaatggtttaattcttttgcggcacccattaaccacgaggttggttattgtgtttgttttgaagtattgtaatggtagcatatattgttgcggtttggccgaaattttgttgaagccttgtgtaattggatacagcagcttccaggttgctggcaaagaagacgatcaaggaagtaattgggccagttgtgtggtagtgtaattgggtttttatgtctgaagtagccatttttggtttttgagcaaagaagtatttgttacgtgtgggtcgtaatgtagttgttatttttcacaattattgtagtggagtagtataattattaggaaaaaaattaaacgttacagttgtaatgaagaagtttaataattataatgaagaagttaccattggtattgtaatgttttgtggctttgtctgctcaaacaaaaaaaaaaattagttagttttttgagttggtggctttgtaattttagtgtggttttgtaatttgtttatcttgttttaaataacaataatgaggaatttataagctctgattggttaagcattgtgaataaaatctagggatgagaaaaaaatttgcacccacatataatacctgttatgggaagtaaatagatagtttaaatggatatccgtggataacatgtagtaagtatttttttacccattcgttaacgagacaagtatggatatcatagtattcgtaccgcgggtacctattacccgtcaaattaaataattagcctcatgtgtattattatttagtttagttgttatagttgttgggatgcattttactagtaaaaatttgatctaaatctaattattcaaaatcacatcacatataatattattgttatttttttatgcaaaacaatttttttaaattatagacgtaatgtttacataaaaaatcacttaattacacattttatttttaattattcttgtaaaaaatagtataattttatttgtaaatat

SEQ ID NO: 6541 - DNA, 1000 bp, Glycine max
  Soy_ogl_1128 Gm03:47314201..47315200 Cluster 29
aattattaaccagtaataaacattagttagtaaattaaaaatattaatatatttatcataatttttaatataatttttattattttctttacaataagctatatatgaattattaacttacaagaccgatatatatcagcaatgaagtttaaaccaaaatttcttctatcataattatggaacgatttgatagatttctccaattatgtaattaataaaaaattgggtagggctttactaaaatataattcctaaattttttatttccccttggcgggatgtttattccaacccccccgttgggaatttgggttccccccgggaaaaaaaaaaagttggctttttaaaccaagtgttctcaaaacggttgtattttccatggaaaaaatggttccctttttaaaatttccgcctttgggttaaaactatggcggaaaaaaaaaaaaacttttatttaaagatgttaggttgaaatatcaccctccataaaaagggggggggggggggggggtaaaatatcagccctgtattttgcatgaaactttattttagttcaaaacttccactttaatcaatttaatttctaaactttataaacaaaagtagtgatttttgtctttttcatgatgaaaattatcttcatgaaagataaaaaccattgttttcttttaagttcaattcaagaccagattgatcaagctaaaaaacagggattatatcaattttatcgtaaaaatgaggagtaaaaatatatttattaacctaaatgtaatatattgtttacatatgtatcactttcttattttttatatataaaaaactaggcagtggtctctgcatagagagaaagagaataaaaagagagaggctaaagtagaaacgttaaataaataaaaaagaagaaaagagttggccatactgcataaaatagaacattaattaggatttgtggcagtggctgatggttttttctttgtattattatagatgaggtaagaaa

SEQ ID NO: 6542 - DNA, 1025 bp, Glycine max
  Soy_ogl_1202 Gm04:3847176..3848200 Cluster 29
ttcaaatcaactcataaaacacattctatttatcatttatttttatctaattttttatttcctgttttattcactctacatttctttatataaaaaaaaaaattggcgcgtcacttcgtgaaaggaaaattcaaagggtaaatggagaaggagttttcttggaggaagatgaacaagtattgtcatttatggcttgtgggagattatattggggtgaaggtaacaagaatgtttgatttttgctgattcgacgataatagaaaacacggaaatccaagcggagcacatgtatcttaaccattcaccggttgcacgggattaggaaccacgatggcttgttgtattcattcatgcatggtttcggaacacattcagttccatgttttttcgcacacaaaaatacagattcaacttttgttcacttgttttaattttgctgtcaaatatgattgactccatcttttagacattgtcagaagtcaatatattactcaattacaagcatccattaaccatttgtttttggcaaattatacttgataggataggatgaatgacatgaaggtataataatgtagtatttgtgaagaagttcaataattaacgtaatctttattaatgtagtatttgtctaattgaaatatatatttatataactatattaatattgcaatataatatgtactataatgtatgaatatcttataataacaatagcatgcactgatactaacagcggacagtacttaacatggagatacttggctcctctttctcaaaatataatatatacactactatcccttctttttcaaaatataatatatatttttatctattaaaatattgtataatccgccaaaagaaatattgtataatgcaagggaaacaaatacataacctgctacttttagtttgctctttgtcgtggtggtgttgtttattcatggtaacgtttcaaagcttgggattttatttttcattttcagatttcacatcacacttatcaatttttttttatttca

SEQ ID NO: 6543 - DNA, 1000 bp, Glycine max
  Soy_ogl_3272 Gm09:43579101..43580100 Cluster 29
tttttgtcaaaagtaattcaaatatgcaataataatatattgtttctgcaacctggactcaagctcatggacaacttacggagagagaaaaatgtgattgacacgttacctgtaagccttgctagtctctaaacgataaaagactatcgtttaaccaccaccaaggtagtcaaccatgtctaacataaaatacaattacgaaactatcgaccaaaatttcattagagtctttcctagttgcaggaacttcacaagaaaattttaagattttgtgacatatagcatgttctcatcacacaaattaaataattaaaagatgtcttagagtgtgcatacatgaaagaaagctagaatcaatgttcatatatagtgttgatctgactctgtataaaaaggaatagagagaattactctctgtatagagttttcccacaattaatagttttctagctgtttactaagttcaaattaaatgaaacacaattttatagtcaaattaaatgagaggaggaatctccgtttggaataaagtgagcaacccaactcatcataggtaattcacatcaaaagtccaataatatatatatatatatatagtcaagtattatgactgaattaataatctccagaaataatatatttaataatttatttttttattataaataatttattaatgctaatccacaaataaatattctctcaatctcccactcgaataatcaattattaaagttataaaattattgcaatcaattacagtcaaaacgtacatgtcaatatatggtttaagaaatataagtcttaataacattagaaaaggtaacatctgaatgagataaatatcatttaacttatattttatatgcaagatagataaaggaaaacataattttctaggataaatatgtaatttcaacaaatgattcaagcatttttataatgttataaaagttatgataataaaagtgttgtattgaatgacaataacgaacgataa

SEQ ID NO: 6544 - DNA, 1100 bp, Glycine max
  Soy_ogl_3278 Gm10:454201..455300 Cluster 29
ttcattaagccaacaacatccatcactactcgttaagtgtaaatgcatcctaacccttgcttaaattaatattattagtggattgtttgtattgaatgggaccacgatgaaccatatttaaccaagccagttagttttcatcttttttcttctttctagctgacaaatgccaaaatggccagaaaaagcaatattgctgacactagccagataagcaacataaacattggaaatcatatcctaaacatggctaaattaaatatgaatagtggatgataaaacatatatattttttatatgaaaagatatcttacaaggatgaaaatattaaattataaattaacgtaaaagacacatattagcagaaagaatcataaaaaaaacgcatcaaataagcataagaaaattggaaaaataaaacagaaggaaaaaataattaaagaaaaccacagtacattggtaaatcatgtatcatatgaaggatcattcttccttaggttcctatttgatcatcaaaatgaacaattttccactctgaaccctattatattccacctccatgaaatttaaaacaatggattaaaaaaatttagttgtaacgtagtgatataaaacgcaatcattaatagcctaagtaaagataaacttgtaactaaagcatgtgactcttatattctgaaatgattgtcaatcagatttctccatatatatcttgtcacttacaaaaaatgaaatgggattgaagaccttaataatacaaaaaatatatgtgtagacatttggcccaccggaatatatattctgtatcattaatgtaaaagacatgtattagagtggatgtggccagatttggagaaatttttattgagagacatttcatccattaggaatactcttaggaaaccgaagatggtgctttacgttaccacgtttcattgaagacaacatggcagctcttgtttctcttactttagacaccccattgaaacttgagacttgagagagagtgtttttacttttcataaagcgttattcagtgtcaccaagattcgcgtgatcttactgttgattgacttgctccaacgtgtgatggattaagt

SEQ ID NO: 6545 - DNA, 1155 bp, Glycine max
  Soy_ogl_4598 Gm14:1290301..1291455 Cluster 29
agttagaaccgagatatatgtatgtttagcagaaaagttgcaagtcctgaatttcatgtacatctccttctttcccaatatcattgaattcgagataccatgccgggccctatatcatggatggttcatccaaccatatatacgaagaacttcaaattaattaacttcgtcataatatgaacttaattatacactgtgttgtaaatagcctatcaattttatataactgataggcatgtggatgcttacctcaattctggcaattcttctaagtttagactcgatcccttcattggagatgaaattctacgttgttagccaatcagcatggcaagaagtcttgcttgatatagaaaaatcaatgcaataaatgtagatatgtagagataatatataggcaaagcctagtatatactcctatgtacctaataaatgtccttttgtgaaaacaaaaacatattttacgctcttctttgtcgagacaacccgctcttatagtgtatattttgcctgaaaagtttgataccaataactgctatcgttgaataattctggggtcgttgttcctttctagagttacagatcaatatattttagattagtgttcctttagaatttgcatgggcataaagctagatgcctataggctagatagagaatatacaggaaagacaagtgtcatttataaatcaagatgatattgttattagaatattggttaaaaaatttaaaaaatatttatggtaaatattataaaaagacataaaaaagttatgtttaacacacttttatgtatcttaatataattattttttcttttagattgattaattatttgtcaaattaaaatgagatatgatatatgtataaaagtttttacaacaatttatacattatttttatgtttttatctctttaccatatcatatattatatttcaattttttttctttctcacttttttcttttggttgtaagatttgttttacagatttatcatttctcaatcaaaattccacaattttttattttttttttacatataagagagaggtgaaaaagaagaagtcgtgggatgtaataaaaaagagaatactccacgtatacaaattaaaaccgcttcaaaaaatgatcataactatgtgacattacaag

SEQ ID NO: 6546 - DNA, 1014 bp, Glycine max
  Soy_ogl_4599 Gm14:1321485..1322498 Cluster 29
cacgttgatgttttttttagctggagtaagttagatttctaattccccgtggaaacaactttgtggaaaacttagtaaaaactattaacgaaaaacattttttttctagaaatgttacgtaaggttctaaaaagctaaaaactttttctttatcaagcgtcttctcctaaaaaatttaagatttagttcaactaatcgtacactctctaattttagagaaatcaatttttaaaaaataagttaaagagtaaattacaaccatactcgttgagcttatatcaaattatatataatcttaccattttttattttcctacattaatccctttaaatttaaaaatattacactaatatcattttatatatgtttgacaatattattctgatactctcctaatatctccttaaatcttaaactaacaccttctattagaaatatgaatgtaatagttaaaaatacaaaaaatatttatataattacatgaaatcttgtgaggtattatttaaatttgttccaagttaaacaactctatcgtaattacaatattttagatggtgttacaaacatatttccttaattacgtgttttatacaaatccagctatcattatttatttttctctttttcacaaattctctttttactctgcacaatacccggtttaaattttccgaggtctacgatagttttctggttaagaatcattatcattttactctcatatgttatgaattaagggtgtggtattttatttagctgcagccaaaagtttttattttttgtttgacagcaccaaaagtttctatttagaccatgtattttactttatttattttaaggtgtttatgacctaatagttatagtggcgctgtacaattagaaaaggaaaaaaaaaaaaacttcagtgggaaaagtcgtcttccatttcccaaatagacgacttacactacctgggtcatcacttattatagctagaatgctaccaacaatggtcatcaaaatataataaagca

SEQ ID NO: 6547 - DNA, 1300 bp, Glycine max
  Soy_ogl_5512 Gm17:4711501..4712800 Cluster 29
ttgttttaattacattttacttataattttttatggttaattgtatgctttaatgtgtgtgaggaattatgaaagggcaaccaagttatagtttttttaagagaaccaaggtaaataacaatcatttaatttaaacatcattatttaatttggaggagaaaaaaaaatgaaaatggagataataagtttcaatgttttatgcgatgaaatattatgtatgtgtggcatgattgggtgaatctaagtaaagggtgaatctaagtaaaagatatgctcaactgcattcatcagagatatttggtgctttaatagattgatatagaaatgaaatcgaaaaactatcagcatggggatgtagctcaaatggtagagcgctcgctttgcatgcgagaggtacagggttcgatcccctgcatctccaatttttattgtgcgtacagtcacgagtctcaatttttttggtcacagcaccaaatatttgttagacgaagaagctgcatttgcaccttagtttccatttctttttttgcatatcacaatccactggtcccaagtcaactctatatatactggcttttttccggttgttgtttctgtatctgtacacattgcataacaaagtaatccaattaacaattcccaatcctgctgcattttttttttctttcagctgcttcttttctctctaagcactaaactagacgtcatcttttcattcccctaaactaaaatttttgcaaggtttaattaaatatttagttcttaaaatattgtgatttttcatttcatgttttttttttcaaaatagatcctcataaagcattttttatttcagatgatccgtttttttttccattttattttagtacttttaaatttcataaattctctatttggttcatctgaaatctgaatggtagactaaacgtgaagtctgtaatttttttttttgaaaggaaacgggaagtctgtaatatttaagaggaatagatatagaacttgtaatatttaaaagaatcagaaggaagaagggtttataatatttaaaagaatcaaaggagaaacaaaaactatagaaatattatttgacaaagaagtgatttttttgaagatctcattgaaaaaaattaaaaataaaagaacaaatttttcaacaaccaaaaatttaattaaaccttttatgcaatgaaaataaaaattgacccttattcctacacctttgtgaaaacttgccatgtacatttttatcatttatgaatctgttcactgttctatcttttgtttccttattatattctcg

SEQ ID NO: 6548 - DNA, 1000 bp, Glycine max
  Soy_ogl_6352 Gm19:2680401..2681400 Cluster 29
taagatatcaaaagtattaatgattgcttgtgccttttgccctcaaatgcctaatccggcacatgtaataaataaaagtattaatgagtatattctttcaatgtacgtgcctttttaatatttagtattgtttaataaaaattttaaatttaagtaatttttttatatttatatgaattgcaaactatattgatttatgcagagagagtatttttcttaactaattaagcatcccgtgatcagtgttaattatagtacagtgtatatgttgttatgaaaacatcaatacctctcatatcctagcttggtcccgcctctttaagtgagcaaaggcactattctttttaatatagagcattgtttgataaaatatttaaatttaaatacaaaataattaataatttgtattagtataataaaaattcatttgattaagacagcaggcagtgatgaatcttctgctaattaacaagtctctgcatttttttttgtgtctgtgaatatagagtcctttgcattttaacttaatggaaattttcattttagcagagtagagtaataatttacattgacgtctggtccgacttttgatcaatcatatactcccatttaatttgtaatttagcaatcctcaacagagattgatgtaatttgttaaattaatggattttttaatgctgaattttgttccttttcatctcaggctaatgctggcattaaaaatttgcaccgtaccagctagctacttcaacctttaggggattgggttggaagaataacttgcagggtctttataaataactgatacgggaacagtttactacaagaaataatcaatttcgtagcgactactaagttgttgacaaagatagatatttgacgatgataattgattgtcgttggaataagattttccttttgtcaacaaggccaattttgtagggaaaattttacttatcctaacaacaaatttgtagctacgaaaagtgtttttctatgt

SEQ ID NO: 6549 - DNA, 1100 bp, Glycine max
  Soy_ogl_7011 Gm20:45978701..45979800 Cluster 29
ctccgcgagtcagttccttcataactgcactagatagcatttcaccctgcattgctggtgacaagaaattggtcaatgaaactatgacgagatgactgcttatacttcttatacttggacacgcataaattttaaacactagtgacatctttcattttctctctctttctattgctctaaatcattaattaaacaaatcatttattttatctttttttttttatttctttgctcaagaatcatttttctaacgagacaaattggaatgatagtacaataatttcccaagtgctaagaatttactcactttgttgataaatagttaatttgttaaaaaaattacttaagtagtgttgggtaaaaagggatgaaagtgtgatgaaagagagtggaaagagactacaaagggaaattatttgattgaaataaaagagtgtataagagataaaaatttaaattaaaataattggtaaataaataataataaaaatttaaataatagagatgaaacaaatgtccctttttttatctccaatatccatgcatgttttcaacctattatgcggcatttttatttttgagaattatattcataatcgattataaaaatttcataataaattatgcaatttcatcagatcacatgattgattatgttttaagtataattgattatattgtaatcctaagaattattttatctgattttttaatgatttagtggatacataattgatcatgatataagcaaattgattatgttgacaacccgcaagttctttggtgatttacatgacaaattatgtgaatatgaaaatgagattatgtatgaaaatattttagtgattacctaatcaaactatgttataagccaaattaattatgttgcaaaggaccgcaatggtcatgagttatgcaggacaatttcaagaagaattattttttttttctcagcagccaatccaaatccatcctctttttttggaagaaaattttacctcatgacacccacaatttttttgaaaaactccggtgtctgaatttatcacaaacaaacatctatcccacaactttcatccttaaatcatcccaattcaatt

SEQ ID NO: 6550 - DNA, 1282 bp, Glycine max
  Soy_ogl_3988 Gm12:3276201..32732 Cluster 29
taaaaaataattataaataaattatctaaagcttaccttttttaacttaacaagtttttaaaaatataaatataattaataaataagcttagacagatacgcggacaagcaattactagatctattgtcatccaatagtgaaatttattaaacggagtgtcaacctgaggtaagtttttatcaaaatgacaatgaagtgtcaattaataatgaaaaaaaaattgacaaaattataaataaattataataaaaaattattagaaatcgttggaaaaaagagtagtcttgaaaattctgtggtgaaaattatttttgaggaaaaatcaattttttaaattaaaaactaatcataaacttaatatattgaactttaacacgtggaacttaataatactttaaagggaaaaaaaccatcaagttaattttctaaagtctcacgaattgttatattttctctaaaataatttgttattaaataaatcctattaagacctaaaatattagcatattagggcagttgctgtaccaaaaaaaaatattagggttgcaacgctggttattaaataaatgctcagttgcttattaagaatgaatcctttaataaaaacattttactttttctaggaagaaaaacttatataatttcattaataatataggtcggtacataataaaaaaaaacatggtgactggtacaaaatctagatgttctagcaaaagtgtgaacaacttcattagcttgtcgataatgaaatgaaccaaaacgtttgatgattgatagagcaaatctacgcacttagagaataatggaacaacattcagaaagattgaggttactgctttgctgcactgtccacaatatattttcaatcaggctctatgacgatgtgatatcgatgcaaattcatatcagcaacccatgaaatagcttcaagaagttcccttaaaaaattctggcacaattgctggagaggatagccacttttccaaacagtttttgctgaaatatactgttatatatatacgaatgcctaggccaaaaaagattttgtgatttgaaagttgcagcatcaacattacactttaaaaaaacattctatatatttattagaagcttgtaccctgaagctaaataagcatcgaatgcttatagtttaactgtttaagggcatatctagattcacgttaaattttctataattacgttgaaatatatgttaacatgtgattttagataaatttttatatattcagtttcatattaaaaaattgattctcagtc

SEQ ID NO: 6551 - DNA, 1300 bp, Glycine max
  Soy_ogl_3978 Gm12:2545701..2547000 Cluster 29
aaatataacacggcaatgttataacctgataaccatacgtattcgattagtacaatcctattacgttgtatggttaaattaattaaaatattttaaattataaatgttttctaaattaacaaaaaattataaattacaattaaatttaattaacgagcatatataatatgaaaatatataatttcatacatttacacttaatttaatagattaatactgaacattcatgaacatataagttgtcttgaaagcaagatgtaggaatattaattaaaacacagttaaaagttaactataggacatagttaaaagtttgtaattattaactccattaaaattaatatttcaaataaaatttctacccgaaaacttatagtatggaaattaacaagaatgaaaatttgatgaaataacaaatacttttcaaaccgctaaagcatttttctatctatttttcgttttcagaatatgttttcactaggtagtttttattgtcgactagtcattacaccgttgatttccatgccccactccttagatatgtttttagcctattacaaagataacacaacatgtcacaagcctattagcctagctataatagtatgtaattcaattaatggcattacataccataaaaaacacaaaaaagtatgacagcaaaaacatatagatcgaaagtatcattaagacgacatgttgtttaaaaagtttgattccttgagaaaagaaatttaacaagacttgacacatgaactttaaattaaattaataattgtcatttcaatttaaatttttcaaatgaaaaagggtttgaaatcacaattcatatatttaggttgtgcaaaaaaaaaagagattatgaaagtgaattttatttttttaacaaaatcttcatcgtcatgaattgaatttttgcatgaggttttaaactctaatgtcagtacagtccttatatacccaaaaaatacttatcttaattatgataaacatataaaatcggatacttactatacttataagtttaaatagataaagtataatactttttaaaatttgagatgacaaaatgaaagttatacaaaccaagaaccaaactaatttggcacaaatgttggagttataactaacgaagaaaatttcacactagtatgttacactaatcttcccattagttcttagcaatgctagtaaggagatatgcaacacagccctaatcttggaaaaaatgaatatttaatctagaggcaatagtatgtatgagcatcggttaacacttaacagtccaaaaagaatattc

SEQ ID NO: 6552 - DNA, 1127 bp, Glycine max
  Soy_ogl_1878 Gm06:9033274..9034400 Cluster 29
atgttttaatattaattaatgagtagcgaatattcacgtatataagtattatgatatccattaacaaacaagtaataaaatatcagtacacatctccatggataccccttttttacttgaagcaaattttatctaagatatttataagtgtggattttttttgtcattcataatcgtgtgttcattgtagcttatgaaagatgaagaatgtttatgtgtttttaagaaattgaaaataaaagttcttgtaaaaaaagtgacttaatatacttaattattttaactataagttttaatgtatcttattataatttttaataatatttttatttgttagatctttagcctactggttatctgatccaacgatcaaagatgtgttgggagcattactagctattatttatgtctatttgaagtttttttctttgaagacatcctgaaggtcatgcctacaccatgacattctttgaattcagattattgcttcgaaaagaagcacaacaatgcatccttaagcagactgatcttagggtcccaaatctttgcttaaaaaagcacatgcatgcatccataagtagaccgcgcgtgcttagggcctcaaatcactacgtcggaaagaagcatggtcgtgcatcattaagcacaaccgtgcttaggaaatagatcttcgcctaatattcgttctagatttgcaacttcaagaatgaccatgcttggttaagtatgtttgtgcataaatcaacacccctttatcttttaaagtgcataaataggagaggaaaaaggaagcacaactcatacactctctttttctttttgttctctatgcacttggagctcttaaaggaggaagacaaaggctttcttaggggatcagttgggaaataacagatggtttatttctttgtaaattaaggatttctcatatcttttcttatggtgtacttccttgagattagtgtgctcatatctctctaaccatgagtatagctaaattcataataggattgtggtgtaatgtatggatggaaccctttttatgtttaattccagttaattcgttgtttgtcttatccattatagattgctctattgttttaattcttgaatttgattaacttaat

SEQ ID NO: 6553 - DNA, 1039 bp, Glycine max
  Soy_ogl_3653 Gm10:49629062..49630100 Cluster 29
atacccgtaggtatgtgtggcagactggtagttgattttgtccccttggtaaacgagtggtgaaaatatatgtttaacttttcttattatacatataaatgaataagtctatctctactctccttatttcactctcatccctcttcttcatatacattgccatgtgtgtgtttaaaggaaaatgtttattcaattataataattttatttaattcaaactaaaatgtgttccataaataataagtttatttattattctaaaatagactaaattaaaaaaaatgttaaaattatgatttttttcaataattaccatgttagattattttacatcgatcaagaaaaacttttatgtggcaaactttaactttcgcattgggttcacatggtgcgattgtgttaccagtaacatcgagcggcataacatctttattattaccccgctggagaacggcacattccaaatttgtcattcatgttcctactttgtaaaagtccacatgtaatattcattaaggcagtgaacttgttgaaattttgaaagtgaccagattaattatttgagataaggttccaacgacatataagttttgctttgaagcattaaacaaaaccctcaaagacatcatgagtttttctcttcacggtgattccccttctggaggcaaagttgttgtatgtgaggatgacttcacacaaattatgctagttttttttaagagaaagtatatcaaatattataaatgatactatcaattcctcatactcgtggacatattgtcaggttttgaaactaaaaggaaacatgtgtttccaaagtaatcccaacaatacaaatgtgcaataattaaagcaattttcatattgattgctccaattgggtgatggaaaattttttgtgcctaataatggatatgcaagaatagagattctcgatgaatttctcattactaattacattggtcctattcatgccattgttcataatagttatccaaatttgctgtgggaatatgtcaatccaaatttcttgcaatca

SEQ ID NO: 6554 - DNA, 1200 bp, Glycine max
  Soy_ogl_4601 Gm14:1422901..1424100 Cluster 29
tgtgagagagagcaaaggattggacttaacttgggcatgattcgatgaatgaatgcgtttcccgagcgagctgctgcaactggcgtgcgcgtttcgcaagaaaataaaaacaaaaaagagcattcataatgcccaaccctaatttccagaggagtccccacaactctccaacatatctatccttactctctttgcctctcctttttctacttctctctctcctcacatcttacaatctcacctttgcggcaaatatgttgatactatatatctattgaattttttactatatgaatagaaccaagtaagtaaatgcctaaatgatgaactcaactcttattataacatatatttactgaacatatgatgaaacgcgtatttcattttattattgtaaaatatattttgataaatagttagagagagaaagagaaattatatgttatttttgatatatctccggttgatcatgtatcttaatcaatcaatatattcttcaatattattgtcgttcgttccttatgtagcacttctcactttgcatgcagtggcaaatttaggaccttaagttaaaaggagcaacctatttctaaaataatttttaataattattacaataaaaggaattgaaaattaaggggtaaaatatacatattttaaatattatgtataattttttaactgattagagtgtggatcttccactgttgacaggagttacataaagtgaaaccttactttaatttaattcacctacttgagttgatcatatatctattttttatatatatattcttaatatacatttttttaccgctattaacctatttttagttttgtattttaatttatatctttatatttgacttatattgacaaatatttgtataatatttttaatatttcttagttattaaaaatgtaatagaaggacatgcataggttttcttttaagttttcttttccccgatcgggtgcattcagtcgtgcgaacatcattcatacttccaaattataacaaaaattataatgggtactatatattgacattaatgtcggaaagattatggatatataagtattgttattgtaagtttgtaactagatcgtgttttataggaaggagatatatgatgcaagagcatttaagtgtgaaaagtgtaatctcatttctaagtaaaatgtaagaatatatataag

SEQ ID NO: 6555 - DNA, 1012 bp, Glycine max
  Soy_ogl_5452 Gm17:1918189..1919200 Cluster 29
acattagtacctagtcttaaaacactcaagattgggggaatttaccgtcaaccaatttatttttataaaataagtaatttttttttatgtttatctaaaatgttttgcttaaaaaaatcattttttacttattttaagaaataaattttttctgcttgttaaattatttttttagtactgattttaaaattatttttattaaatttaaacaaactgatcatgtatctatctaatcaattgggtatattatttttctaatcaaaggccaataatttttcatcttttcttttttttctttttttccactttgtccctctgtctccatcttccccagtagcaatcagtcaaccatgccccgaaacacctccgaaaccaccacaacggcgacatggaaagaagccaacttgggcgataacaacggcaacggcgaaaccaccgcaacggcaaccatggactcatcattcatgaatattttctatctaccttgatagacttatgctataaatttggaagtttgtataagatttaaaaaatgtttctccttgaatgggacatggaagtttgtataagatttattataaagcagaaaagatatgttcctgcaaaaaataataatcagtttaaataaactcataaaaatttgtttattttattagaaaaaagtatttttgttttcaaaaataaacttaaacaaacaagcccattattttagcatagtatttttccatttttctaccaagaactttgtcaaaacctcggcgtactaaaaatctcagcatacctaatgtattgagtttttccttaattttgagggttaaaataagtagcaattttaaggaaaagaattttagtttgttttttttttgtaagttacatttttttaaaataaccattcacttaattttctagaacgcgtcacaactttcttgtgatatataatatacgtaggaggatatctttcaacccaaaatgcaagtctgagttctgaaattaaagtagttaataatctaaa

SEQ ID NO: 6556 - DNA, 1328 bp, Glycine max
  Soy_ogl_1121 Gm03:47097301..47098628 Cluster 29
cagacaagagtgatcatacagggatcctaaatttcggaatgtttttcacgtgaggaaatatataaagtacctttttttttttttatttcagtccctttccgattcatagtttgggcaaaaattataaaaaaagatgaagcattaattcttgccgtaattggacaaattaagcagaggaagaaacgctaaacatgcacgaaatagaagtattgcgcaaattttaatattgaatttggatataaacatggaagatatgatttgggttttcctccactgggcactaacactttacggctttatgagtgtccttttgaagtttttatggacggaaatcccctcctctgtttgtttctattcttgttttcctaatgaaaaaagcaacactgcagatttcattagtaaaattaattaaaaaatgttactatattttttaaaagaaaaaaaaaacacgcaaaagttttattagagtataagagatagggattaatggttaggcctcatccaagaacaaaaatgctaaagacgatatgatcaggcttcatatccaaaatttaagattgatagtcaacattattttgtatgataacctagttatatatatatatataaaataacaatgtatatatgatcaacaatttacgtatgtcctctgacaacacaatcaacccaatcattggtaaccaataagagttcatcaaaatccacaaaccactaaagtctcttagtccagcaaaaaaagacaccacaccaaatgttttaaaaatgtcagattctaaactagatataacaagtatggagtgaatacacacacctggtccagtgccaccttaacagacagtgtttgagttaagaattatatatgaaagacctcactatcttaatacgtaactatatcatcccatgtcttctagcttttacatccacgttggtttcatctccttctttctcgcttcgtaagtatattaatttgtaagatattttaagcaatgttgcttaaacatgttatggatattgtcatggcaacgatcacatgaaacattgtcctacacacaagttaggaaataattaatatgtaagtgtaattacttaattgtcaaataaccatagttaaatacatataagttacctcgaatttgctttgttagtccttccaacctcttcagaggttttactccaaaacggtaaagaccttaaaaagtgtcatgatggtacttttaatcacataagcagccatagaggtcgaagtccacatgcaaaaaaatccaaaatcattttcaccatcaaattaattgtgtatatgaattttagtgcttagtatatacacaaaa

SEQ ID NO: 6557 - DNA, 1000 bp, Glycine max
  Soy_ogl_3658 Gm11:179301..180300 Cluster 29
atggttccagctgaggtcatcccattccaaaacatgaaaacaaagttttactcagcttatggtgccttgggagattggaggaggcaatgcagaaacggtagagctcgtacctgaaattacagcaccaatcagaatgtgaatttcattgtctgtatatttcatctagtattacgcaatctatgtacggctgtgatattacatgacgcaaagtcgcaagtcaatccattgatttgatgtgatttattctgattataatgtaaacgatgaattatgggagaggggcacttcatacggatcaacaagtagcagattcagaacaaactttcctttacaagcagaacatctaacttcacaattcacaagtatgggtcttttggccctcccacacaccaataaaattgatgtaatatattaaatattacaccaatttaatatttaataaattgcatcaattaacttcaatccttttgtatttcatatttttaatcacaacctcattaaaaattttgtcaatcaatattattaatcttaaaaaaaactacacttattatttttttaaaatcatggtattgataaagagtttctttcattgaaatcagaattattctatacccatagaaaaatcttaaaaaaaactacacttacaaattattatcacttatttcaacccttttttttattaattacacatattatcttaaaatattatttgtaatgaatcatttaaaatacactataaactaataaaacttcatttcttcacatacttatttacatattcaaataatacttttttatgattaattacaccaatgcaacgtactaacattccatctaattatgaagtacacttttatttatttatttataaaagttatgaagcaagctgaacacacacaccaatacttttttatgttttagtatttttttttccatcattttgattgtaaaatatcaacaaatagttgcatatatttttttattctatctttaacactta

SEQ ID NO: 6558 - DNA, 1300 bp, Glycine max
  Soy_ogl_445 Gm02:8639501..8640800 Cluster 29
cacttattcttcttatatagtccacttacaaatacgatcatatctaaaaaatattagctgtagttcgtttttttatgcgtcagaaagaaagccgtagttcgcttaaaactcaaatctaaaagacaattttatttaataatatttgcaaattttctctgctataatttaaatataattttagaagttatagaggcatgcaaaaattactacacgagtaaatatagatctagaaacattcttttctaaaaatacgaataagaaaaataagaaacgtaataattgcatttacattattacgggttctgggagtttcatgaccaatggttggtgagataatattcctcgacttctagtttatttcatgttcatacttcatattctcgactctacatttagccttcttcgattatgcgaccatggcattccacgtgatagattcctaggggggagtgggggacaataatatttcactcatttaactgataccaaattgccaatagtagtaattcaaatctaaaaaaatagtattgaaatatgtatgttgtatagataatattgaaaatgttctcaagagaggaaaaagtaaatattaaaaatgcttaattaaaaaaatgtggtggtcttgttgtcttggcattattgatggctattagagtctttaagaggtctatctttctatggttattttatatttatgttagcattgaggcattaatatttttgtaattatggggaatgtctctccctttccttctccttttgtctttaagtctatttttttaactagtatcatccatttttttattaatcatattatctttttggttgaaaaaaacaaatacaggagtagatattcatattattgttaaacagaaaataacacatttaattaaaacaaatatagtattgcttttaaggactttactactgaagaatttgagtttaagttcaagatatttcatcaataaactatatatatgtcatcatactgcaattttcgatatgattaatagctttttatgattttgtattgaataaactaccaattttttttttgtaaaaaaaattaccaaatttgtctacaaattattaccccttctcttaaatagttttaaggtaataaaaatatttaaataacctcttatatgttaaatattcatcacttaattaaccttgtaagttgacgtattcgagtaaagtttaacgatcatactgaagtttttttttaagtatttagaaagactattaaacatgatttttaatatttcaagaacttcataataaaaaaattgttgctttg

SEQ ID NO: 6559 - DNA, 1115 bp, Glycine max
  Soy_ogl_2098 Gm06:46733401..46734515 Cluster 29
gtaaaatccaggcaattccttattttatatacaataaaaaaaaatgtactacttgtaatgtgataataaggtatactaattaagtagataaattcttcaatctcccttctcccattctccccctctaaaggattttggtcttcccttggttggtaccattaaattacatatatagctccaaagaaacaaaactttgctagaacaaatatcatcaaaaatttcatgttgacgttatgtttgttttgcatggagcaacaagaatatataactttctcttttggatcttgttagacatcattacaagtatataattccttttatatatgcatggttaggttcatggcgtcaagattgctagattttttttttttttttttatagaaaatgatggtcagattgtatacgcaagtttatgctaataattaataaattgggttaaatatgattttgatcctccaaatattgactcattaattttagtcctccaaaaattatttctttgcattttcatgatctttgatattttcaaaattttccttccttttaagtcatttatttaactccgctaatatttttgttaaatgcaagccgatcacttattgtagacaatgtggttgaggcaaaaaatatttccataatagttataattaggttctactaacagcagaggtaatatatgagtttaattgtatatatttgcttaggaataatagttataatgtattttttttcaattatttcaagtcacgctaaatgctagctaattccggaaatgaaaatactaatgtttgaattataaacttttaactgaaaaaatgatagtcttaaataaaggacttaaaagaagaattttgaaaatttcacaaaaatgcaatgaaattatttatatatggaagactaaaactgatatgagtccatatttggaggatcaaaatcatatttaattctaaatttattagaaaatgaaaatacaatttatatattaaaatgaaaataatcaattaagagagcctaattgaataaaaaattatgagttgttagaaatctcttatatatgttttttattcctatacataaaaaaacataaaagtaataatccataaaccaccaagtaa

SEQ ID NO: 6560 - DNA, 1000 bp, Glycine max
  Soy_ogl_620 Gm02:43063901..43064900 Cluster 29
atcaccattatcaccgaccaaaaatcattcctagagaaactccatgaaatagttatttcgaggacacatctaaacacatattggcataattatttaaaacctcttcaatatgaaattttacttcaatatgatatatttgatagtgtttacaaataaaaataatcatatttttaaaaaatttgttaaattttaaattatttctttgaataaaattaatctagtgtcaaatatagaattctatattcccatcaccaacagcttttttcaccgtaaaagtgtgtttcttcttaacaaaagaaataatttggttaagttgttaagcttttaacaaatttaatgtatataatcaattaagtaaattgcataattagttatgtaactttatgggaagtcacctaaaaacaaattattgtttagtaatcacctaattaattatactataagcataattgattatgttatcaataacaatccacaagaataaaaaaggatagaaatatctattatggaaacttctttcttcatgtactataagtgttgcatacaggttactttcactcccattttatttcattttgtgatgaaaacaaaacaccatggaacccacctttatttcaaaactttcacctacctttcacccagaccaaacattcatatcctacaactttcatttcttttcggctacaatcactttcatcgtttcatccctctaaaccaaacattactttcagagaagtggggtaatagtaaatcaaattatactacacccaaatattcttttagaaaataaattatgtaagatttttataaaagtctggttagttaagaaaaaccttagattttaggtcatttaaaaaataaaaataaaaatgcctaacaaagctttcctattttttttttatcttttttataaataaaaaatgtattaaacatgttgacctatgtaagcaattaagcctatagacctattaaatatgatagtttatgatttcaataattt

SEQ ID NO: 6561 - DNA, 1200 bp, Glycine max
  Soy_ogl_4583 Gm13:39793801..39795000 Cluster 29
ggcaaaattagactatctattatttaaagattaaaactaatgtactccaaataattactgaactaagataaatgactttagttaagaacatttttgtataaaaaaattaatatgaaaaacattttagatttaaccttataataagaatcaaattatacttatcatttgaatcttataacaaagacaataaggattaaataagatcaaatcaataatgtacccaaacacatgcagccgataggttgttctctctctctattgactctagacaattgtctatcatccatttattctgtttacatacaagttgtccttcgtattcagttgttgtcgcaaatgattcacgacactgaaatttatattacagcatgcagagatttttggagatctcatttttccaaacacttcataatactcatatctttttctataacattatatcacttattatatgtattattttttattttttatttttctctcactagctaaataccaaaaatcatttttgttctacagccacagagaaatagatagattcaaaatttagtcttggctgtccaatagaatgaaaggcttctcattttcgtttcatgaatggtcaacaaaaccccagcataggcttgaagagtatgtagatatatgaagaatttcttgatgaagtattcatgtacgtgaaggcaatacggttagtataaattgagactgcagtggatggcaaaatagaagacattgctgttctagtattacataagataatgcttgcgcaaggttggcactaggcttggtatgcactgatgtatggtccttcttgttgttaattatgtataatgggcacccctttattcaagatcaaataatattttatctagctaacaaaaaaaaggagagaaattaagatataaattaaagaattttttttaaatataatatatgatatgataaaaaaatgaaaagtatcacttagatatatacacagaataagtattaatgtatcattagtagtagaattagtatcaacatgtcatgacttttggatttaaatataaattttggatgtaaaatttgggattgggaaggtaaagattatcggctcttttgtttcttaattttgaaaactatttaatgtttagtttttttttaagaattatttttaaaaatcacataaagaaacgacattctaagttttcttcccaaaaa

SEQ ID NO: 6562 - DNA, 1000 bp, Glycine max
  Soy_ogl_4592 Gm14:710201..711200 Cluster 29
cagactaaacaatagactgaaggaacaataatgaaagatgactgaaaagagagagggttaaaattggaagttaaatttcataaagagcccctacagaaattgaagaagcaaaaccaaaagcaaaagattggagtcaaacttaagtgcaaggcttatttttaggggtttccaaacatctgttgaaactgagttttgtgctctaaaagcatgtttgaggttgcccactgaagaaccaaacatctcttagtatgtacttgaaactcattttctaacacaagttcatgtctctgcatgttgaagacctacttaagtgaaagttgctttttcttgtttcctgttggacatgaatctcgatcattgctccaaatgcataagcaaacatgtaataaaatttaagattgttgattaaacataagcaatcttactctaattgatgtacgagtttggatataattcttttacttttaaatatattgttttggaccattatacagaacaacactacctacacatacttatacatatacatcttatatttacttaatatctgacccatacttaattttacggatttttttagtgaatatgtataatttgaaattaatttaaaatatattatatttttaaatgattaaatattttaaaaaaacaattatatattttaagcagaatttaggaagtttaagcatgttcagggtttccacttttgtcttcctgattttccaattttcttttctcttcgttctcttgttacaaatagaaacgtttagggaatttttgtaaaatgaatatttacccagattcaatttttctttaaagttttttaaaaaagtaattattttaaaattaaattaaatgtaatttattttaaatttaattaatataagtgtttgttattaccaacaaaattttaagaaaatatattctaggaaaggaattcaattttggaaatacttaaaaaaattacatttatttctttttaaagagatgaataaagatt

SEQ ID NO: 6563 - DNA, 1300 bp, Glycine max
  Soy_ogl_4457 Gm13:35266101..35267400 Cluster 29
taatctattggattaaaagatattcatggtgtctaatccataaaaaaaacataagtgtacttttttacaggtactttaaatgttgtctttagtctttaccatgtaaaattttaattttaaggacaaaacttatatgcaatatattggtgttgttctcccattaaactttttggtaatttatgcttaagctttaatgcaaacttttattctcttttgtcctatttataaaactcaattactcagttcatcggaattaaaaaaaagtgattaatatagttataatgttaaaaggggtgtttgtaaagacttctcttttgtaaaaattaaattgtatgtgtgtgcgtatattaatattccagaaattatatagtacagaaccagataagtccgaaatccatagccacggtaaacaaattcagcaatgactgcaggattcccacgagatcactgaacactgatgcacaaagagaaaagtatgtattgccattttcctttcctttctcaactcacaacataaaatgacaacggacaagcaagcaaacagttgaagaactgcatgcacgatgctgcaacgtccaaaaccaaaagggtacgtagttcctcttcaacaagaaaactcattctctatccaattctaaagccacgcttcttgtgacatgacattatggttgagttccgaggtagcttgacctttgaattttagtatttgtccacctccaataacctcggattcggattcccctatcagatcagtcttgtcatcttcctgcttcttgccatttcatcattcaatattttatgtgcctattcattacattttgcacaattaatatacatagagctagagaaaggcttgttggagtatacatatcaagtaagaggactgtttatatgatgaaaataataaatttattcacatgatatagcatcattggtatataatcttcttgtcattcatattctaacaaagttaatcattaatatttattgataaaaaattattgctagatagcaaattttaataatacttaagatattagtcattgactattacccgagaaatacccaagttcaccaagaaaagaataaatttaaatcatacaagtataaataaataattaggattaaaagctaagaataaggcataaagaagaatagatggtttcatcctaacaaaatacttttcatacaccttcctgtctctcactcgctgacaacagaaaaaataaggtatattatatttttagttgctaatttttttagaattttttaatgattgatttttttactatttttagtc

SEQ ID NO: 6564 - DNA, 1300 bp, Glycine max
  Soy_ogl_4602 Gm14:1663601..1664900 Cluster 29
atttgttgggttgtttaagtatgtgtaagtattctatgataattttagtacgtgcttgttgaggccatcaattttaattttattttccttatatgaattcagcgtgaaaaaataaatttgaatatgtaattaaaaaaaatagaatgagaagggcaacatgttttgcttgatattctcactctgtaatagataatataaaatttatatgttaaacttttaccggccattttaaagttgctcctgtagtcttttgttttaccggcaaacgattaggcctttaccagcattcacataaattaattaccggtaaaggctttaccgaccctggagctggaagcgcttgccaaaatccaattgccgccaaaactgaattttggtgtagtttaatttttacaaactttgacttggggttttatcaagaaaagttcagttatttttttaccagttcaattcggttcagtttagcatcaattcggagttctttttttgcctagtcctacttataggttattgtattgttactcattttgacctgaagttaaggtgatatcgatcttcattgtatgggagctagctaatagaaggaatggtttgaaagatcttgaaactaatcaatttctgattgaatttgtcttgcatgtcgttggtctaattgttctcaagttaatgttggtaaaccttccgtaacacataatttcatgatatccgtaaagtacatacatctgtaagaaattatagcttgctaatatttcctttcgtatttctcttcctatgtccaaattttgttatctgcataatatgtatatgaccatgaaacctacacagttagcaaacttaatctttatattatgaaagtctaataatcgaaagttatgaatatttaattatttctttttaattcagcatttaattagttttacaattttatcatatataaaattaagcctttttttaccaaaaaattacacaatgttaatatttatgttaaatctcaattgtttccataaaaaattataataatacagagtactcttccattctaatcgtatccaagtacttttgatttttttttttttacatgacttcaaggttagtgttggccccaaggttcaaagactacttataaattatccactaacaaggtccttacatcctcagcagaaatcaaactcatacttgtgagatatgagactcatttcttataactggatcaacctttgttggcatccaattacttttgatttaacaaatcaatacgtgttaacatcattacttgtggaaagtgaaaactactttcatt

SEQ ID NO: 6565 - DNA, 1177 bp, Glycine max
  Soy_ogl_4606 Gm14:1995501..1996677 Cluster 29
gcatatatgtgtctattttgatggcatgtgaatcacacatttatctatattgaatttacaacaaaaaatttatttccatccttacaagtttggtcgacatttcactttagatactaaaaatgaatatgcgcgcaaaggaaagttataattcccttgtgatcaaggttggtgcaattctagatattcttgtaaattttcagcttgcttatgctttgaggttcagaagtattcaggaggtattgggtgatgagggggataaacaacacttttatttttattaattttctttactttattttataataacgggtaaaaattaatgaaaccaaatgtaattgttactggtactgagcgcatgaaagcaaaagttattttaaattaattaatgatatttcgggcttgatatatatatatatatatggagactcatacctttttttaaaaatatgtaggaaaaaaacccacgaatcttatattttaatttatttatttcaaagatgttatcataatttaacatttaattgtttaaaaaaaaaataaaaacttggtttctctcccttctgtggtatctcatgtcatcaatgcatttggcttttttttttttagttacattgtcgtcatctcctctctactagactactaccgatgaccaccgtgatatgccacattgaatccaaattccaaaaataaagcctcactattatttgatttttaacaatattttttttgtctaaatctttgataaaaatattattaaaactctttgacaacgttaaaaaaaatataacgtcaaattataaaaaaatatggtcaattttttttttttctgtgacatgtgtaatagtgcgttaagctgtaatgcaacaaacacgcttgtaatttgatcgaccacctctggctcattggtgttgggctcctgcactagctagcgaccatgtaaatcactgagttaaaacatagcaagaaagagaaaatgcattgaaacggaagacattaaagaccagagacaaatcgtactctttttttaattttttaaaatcagattaaatgttaaattacggtaacatccttaaaataaataaattaaaatattaaattagtgatttttttcctacacatttttgtattaattgctaatacacatacactaagagaggatataagtatgttaacaatc

SEQ ID NO: 6566 - DNA, 1078 bp, Glycine max
  Soy_ogl_2535 Gm08:6980601..6981678 Cluster 29
ttttaaaacagataaacaagctggttacttatatccggtaatttacgtagagacacacacttagggtgtgtttgaattgcaattatcacacattaacccatccaaatggaaaagcttctatcttgatgagatgaacggacggtttttagacgttagaatgaaaatccaaacacacttactacatgtttgatttttagttaaaattgttttgacatgtgttataatataaatgtaatggataaaaataaaaacaacaatcatgactttttggcatcgagtttttaaacattgcacttaatttggtacttgatcaccttaggtagagccaaaaaataaagtataaatcagcagggtacgaaaaacttgtgttgctatcacagtttcctgagttattgaaggtgccatggattagaatgatagcccctgaaatacgcattgctgttaaaaactagttgaaagataaaggattcttgtaccgtagctatctagagaatatatacagagccaaagtcttggagcgtagcaatctaccattgagagccaaaaagggaagggttgcattaaaaggtggggtaagaggtgcacgtggtccaagcagacactagatatcattatcagggtaaccctgttggattggagcaccctcttcgcttttgctttggtttgaattgtcaaagaacaatcaccaaaccacacacccacttttccttcctccttttctgatacactataaagctttaattaatctaagatatacatacatgaatgtaccaaagataaactcaaattgtagtttcttaaagttttatataaaaacttgtaaactaattgtggttcttaaataagttgattttattttaatatctttttatgcactcatttttaaattcttctgactgtttattattatacctagacttgtacctatactatacaatgcattagtaaatgtatttttctattcatatatgatgttaattacgtagagtttattaaatatattattacttaatattttggtaaagaaatagttaaaggattatagtttacactaacagttaatataataacggatagc

SEQ ID NO: 6567 - DNA, 1057 bp, Glycine max
  Soy_ogl_3444 Gm10:38178344..38179400 Cluster 29
attcattgaattgattagaaatgcacctctcagagaaagaaaaaaaaatattaaatttctaattgagaaagtgagatgagtgaaaattgcacttttcaagtttgagatcctaatatatactaataaaaatattaaatcagttactaagattaaatttgttaataaattatgccattttttaaaaattactcttaaatatttggaacttttcatctaactattttcacgtaattatttttatatgattaattaatgtttgaagaaaaaatagtaactgtgtaatttatctaattaatttgtgtttggacaaagagataagggacatttctttttaattcacaaacagtagttattgtttatcgagtaaatttttttagagtaattaaggacatttttgtaaataaaaaatagcacaacataatttagagggattgttataaaatgtgatcttttttcaataattatggaggattgttaatcacaatctcttatactttcttttcaatacttttttatgatcagataaaaattattaaaagtctttcattttggtgagtctcatttattattaacggttttatctcctaatttaaatataaaatctaccaaaaaattattgggtgaatttttattttggttaaaaattatctttgctacaaaaacatgaatgaaatacaatttggtggtacatataacaaaactttattttcattattttatattttcaccctatgtatgcaaggcaaacatgattctattgtaatgtgggcaataaaattatatttccgttgttgaacaacaaccaccccaacaccacccgatcaccatccaaaatcagctgacaacaacaacgcaaacaataacaaccacccatggtgtcgccaatcacctatgtcatcgtcgtgtcgccataccataccaacaacatcactgtgtaattaaacaacacccccagatagtggcctaaacaacaccccacaccaacagatctgcacatgataccactagcaccattgtgccactgtgcacatgccatcccaccttggctacacccaaa

SEQ ID NO: 6568 - DNA, 1057 bp, Glycine max
  Soy_ogl_6463 Gm19:39661301..39662357 Cluster 29
cggtggcatgcatgctactccatataatatatatactccatcaatccatgcttatccttttcattttaggtaacaactgttgtatttattgtgggtaacacacaattttttaacatagacccactaataagtgctgtatattgtgggtaacacactatataatttttttaaaacatagacccactaataagtgttgtatttgttgtggataacacctttttatttgaaaaaaaagtcacatttctttatataaataagtgtaaataaaagggtaaacatgtcattttagttttcgaaaagaaaaataatccaaaatccctttctctttgtctttcccgccaacaattattcctggcaatgcaacctaaaattcatttttctctcacacgaagcattacacttgctctcatcataccacccaacaatttgttcgtgactttctttatgcagaaattgtgtatatgcttgcagatcttattcgttaagatgttagcacgcaaaccacccaacaaataacaacctttggatcttttccattggtttaatcggaaaaggcatcgatcacaataacgatgatggcccagaagaatgatataatggaatcaagctctcactttggcatctttgccagtaccaaatcttcaaattaacttttaaggagttataactcagtagttcattgctgcagaagtacacacacatatttttaagtaaaaaataatattttagaacagagaaaatgtttttcagaaaaaagaaactaaaacactttcagaataacttcggtgctagtccaggacatttcaattttaaacaatggcgatggattgcttttattatccctaactagatttagactttaggactatttttatttagatttttattgtatgtaatgtgctatattttatcttcattcttgctgaaaatatatatataattttaccataataacttagatattaatgtcacataacataacataatagcttagatattaatgtgacataatgcaacatgtgcatctctttgaattaaataaaatttttctacttgt

SEQ ID NO: 6569 - DNA, 1100 bp, Glycine max
  Soy_ogl_1798 Gm06:5732601..5733700 Cluster 29
aagacatgaaagaagatacaccacctattgtaatgtaagtagagtgtagtaatattaccgtatatgagcatagaatcaacaaaatattgtgcctgatacgttttcattaccactttatttatgttaacaaatcaacatagtatgaaaatatgatactttagaaatatttttaatgtgtattaccttccatctttttttttttttaatgagaaattcgattgatgtttttaataggactatctttaaattgtcgctttttaagtgtcaacctatatagttgtgtctaataacaaaatatatttaatttttaaaaaatattaattagcctcgactaggccagcataattattcaagttttatttttttaaaatattattagcgtcggcctcaaccaatgcaagctaaaaaagataagaaaaatatatattaataaaaagttaacgataatacttgttagtgtcggattatcgtcgagtacactaactagctaatacgaattttttgttgtagtgatgagtgttaaatagatttttgacataaaattttgtcaattatctcgtttacctgtaatgatgagtgccaaatggatccttgataacatgaaatttcatcaaataactcgtcacttaatagactatttctaattagaaaggcttgaggagtgaaaaggttaatgttctttatataagaaccaaaaacataaaatacgtatatcatggagagaaacatttcattctattcaaacatgtttatgcaaatgttattgctcattgattaaaaaaactatacttcatacctgaatggaatttatttaatactaaaaagtgcacatttcaaaaacaaataagtaaacaacaaaaggcgtattactgctactaacattactgatgtctaataatgatgattgtaataagacattttttttagattctttcttgccaaatgacattaaaatgcaactttttcatgtacaaagacccttgccaagttattgtgctgcacaccaacttggcatcattttcaactttcatttatgatatcgataccaactcctcttccgttccatgggcagagattttacattttaagaaagaaaatac

SEQ ID NO: 6570 - DNA, 1000 bp, Glycine max
  Soy_ogl_2077 Gm06:44844601..44845600 Cluster 29
ataaattaaattgattattttctaagtatatgaatgaaattgtcggtgcctggaaaatacaaggactaaaagcggcatttatcctatataataactcccacatttttgttggtatggtacttctagttagttgacaatgaatcattaattctcttcctactaaattagtctatttggaaggaaagtagtgcctcgctccaattgcaattcatttcaaagtcgaatatcaattcttgattagaggatactactgttaaattacttacttttgatttatacttaccccactaattatataaaaagtctattttaagaataattatacacttattttctatttaacttccatcatatcttttgttttgtttaaaaaagatatagaaagacgtcaaccttctttttctcttggttgataataaaaatataataaattataggcgtccacttaaggtttcatctattacacctaatacatctctgttttgtaatcctacaaaaacaaaattcctaatttcccctcgtataacacctgacaccattccctccacttgcacccctatgttttctatgaattgcatttaatatgtcggtttattatttttttttcctttagttttagtttttgttgtgaattatgggtgactaatgatataacaatgacattaataacttaaatgggacatccttattttttttttggggaaattatgtttttaattttgaatatgtatgtttagatgtcatacaaattgataagtgattaaaaatataattaattaataaataattatatattattttgatgatatgacgtgtcaataaaattctaacatcattatctcatcaattaacattgttacttaataataggaatttaaataacaaaaattaattaataaaagagtatcaccactggggatcgagtggagggaagggatgttcaatattatacgaggagaaaaactatagattactgtaggattataaaacaaagagatgt

SEQ ID NO: 6571 - DNA, 1300 bp, Glycine max
  Soy_ogl_4846 Gm15:924901..926200 Cluster 29
tagttaaaatatcattttggtctattatgttttcgtatttttttatttttattttttatgttttaaaaatttcactttagttgtttatgttcgtaaataaactcaaaatgatcattttgtccccattaaatgatgacattttaattattatttgtattaagttttttggggttcattttatggtgatccaaaactgtcaagaaattgcttgtctaattcatttaataggtattaaactgtcattttggattcattctcgaacataaaagtttcaagatgaaacttttaaaacatgaaggaccaaagaaaaaaaaaaaatataatagattaaaatgatattttttagccttttcaatattcagttatagttagttaccaactttccaattagttgattctcacatcacattgtaaataaggagttagccgtgtaaaagaattcagattgaataatacaaagaccagtgcaccctgcattatggtcatctccttggtctcatttctaattgattctttgttcaggtagatctgatatttgataatattctttgagagatttggaaatttgagaagcctgatagagcaaactgtgttttctcaacaagagacgatgggatggtcaaagaagataaggtaatcagaattatattgtgagaaaaaaaaaaacaaagaaaaagaacaacggcaattgcaggttgtgcgtagttggtttggaaagaagtgtgtagacataatgacactccatttcaactctgtcaaagaataaccaaaacatttattttgttttcttcaatccttgttaagacccaacccattcttttctcttcaattctttctgtttcatgtaatttatttttggttctcacaaaaaaaaaatgttggaattttttcttatttatataccctcacatgtctaccttgctatggtgcgattgttaaggtacaactttttcgcaactgaggatagtttgttggggaaatgatttttgtttctgcttttggatgattgcatatattttctggcagttttgaaccaggtttttcttgttctgtgtggatctctgtttttgttacacctgtggaggacttgagatgatgcccttgttattgccttagaatgatatgattatgactcttagacttaggcctgttcaaaaaaccatgaactatgaacttgattataattgaactgcactaaatcattaagtaaaacatcatgcgggatgaaaaatagagagaaacatcccaactatgttggcacccttctctccattagttccttgccactaccatctaaatt

SEQ ID NO: 6572 - DNA, 1077 bp, Glycine max
  Soy_ogl_7016 Gm20:46358689..46359765 Cluster 29
gcaagcgggggagcatgaaacatttttaggcatgatgtactgtcttttaaaggcatagactccattcggatgaattttggaatgcaagtctatatcttgaatacgtgcaagataattctaattgttttatgcctccaccaactttcttaacacacgataataatttttatattgtcaaacaatactttatcttgaattaaaatttcaattttttctctcaaactttactaggaaaatttgtgggtaaggacttcaacattaaataaactgaacaaagtatattgatgttttcgttaagggatatttaaattctattaatagctttgacgggtgtcaagacttctcatattgtttgacggatgttcatttgcaatgttagttctatggcattcctgattaataatcccgaggcaagtaactagcttgatctggcattttgcaaatatatgaccaagaagcaagctgcaaactttgggcatcgttattgtttcctatggaaagaagaactcctatttgctaattcttgttgaacaccatctaatagtataacgaacttagaagagttgggtagatattttactaataatgttaactcgacgaattcaacaatattctcagtccattttaattctaaacttgtaatacctgtgagttactttttacgcaaataaattctaattttttttgctcaaacctagttgaaagataggaaactaaatgttatcaaaatttaaaagtacaagacacaaatttatgttattaccggatgcaattcctgtgagttgcatatgtttatttaaatataaaagataatttgaataaataaaggatttattatctttttataatttctttttggcgaggactatctttttataattagtaacttagtatcctgtaatattccatcaatactattataaaaatcatccaacctccattttagttgtacacctgttgacataatatgggcccacacacatttatttaacttctttattgcattgcacattttctttcttacgagtcattgttatctttttttttttttatcaagcctgtgcaaacagactgcta

SEQ ID NO: 6573 - DNA, 1300 bp, Glycine max
  Soy_ogl_4415 Gm13:327301..32776100 Cluster 29
ggacaccattgcttaggatttaggaaaacacaattaaacatctagtgtagcaattgagttgactaaggtgaagatgacaagatgcgggcattatattctgcagacacctttcattgtattccagaaaattcattctgaaattcaattttacagaaataaattttctgaaatataatgggaggtgcaggatgcaataataaggtgcagaatgcaatcgtccaagttgtaagatctttggtccatcaagggcccaatattacctcttatttattttaggaagcccaacttcacctattataggaataggtgctagggatgcttattatgtaaagcataaaatctagaaattaagtaaatggcgaaactatcaaatcgaccgagtgtgagatttgggggaaaatcccaatctcttgcaaataacccagaataaaagtttcatttttaatctatctcgtgtaacatgcatgtaggtatctccccttaattttaacatctattttaatatttattaatgttgacagaaagtatttgttcattttgtaaattattaaaataactcaaactacgtcagtctcgataaatttttagggaagtcatgcgttcattttctgtgaatcatgaaaatatgcaaaacgacgttagtctttgggaaagaaaaaatatcaaaagtttaaggtattttgcaataagtgcgacaagaactttagtctcgataataataagagaaaattgattaatcggtagttttcataagaatcgtgaataagtacataaaatgaaaaaataaagatatatttacaattgatttataatataccttaattattttatgatttcaataaaaaaatattagaactttaaagtagtgtggaaaaaaaattattacgactttaaagtcgtgttaaaaaaaagtaaaaaattataatgataaataaaatttataacttaatgaaaaaaattgtaaaacaatttataattttcaaagacgtcatacattattttactattaatttcttttgaaatattaatttaaattttactccttttggtaaatttgtccccactgggatgaataagttcacgaaactcgtgtgacaatgagagtgaagttgatgtctgtcagcaccagccaacatcttccggaatccttggaacacagcaacctgataggatgaaactccttcaatcaccccaaaatcttcaatagtgacaccactccactgctgctcaaagggcactagtgattttaatgttaatggagaggaaaagttcaagaagttagcagctggtgttatatcat

SEQ ID NO: 6574 - DNA, 1167 bp, Glycine max
  Soy_ogl_2518 Gm08:5229501..5230667 Cluster 30
cactgataagtattccattacaattaattgatatatccacccaataatgcctataaaaggacaatccaatgactgtctttgagtttatacgtatattttatatatattgaagatttcagctactcggataaaaagaaggttcttaattagttatgtgatataacttaattttcagtatttaacattcaaactcaaatctttttattaaactaaaacaattttacgccaattactcctaactcaaattctaaaaccttcttcctatttcttttcactccatttctacccaaataaacaaacatcaataaaataacgatttttttaacatgtgagttttaaatagacataataatttgtggacattaaatgttggtcgtagtagttttgttttttggtacgagagttatgaaatactctgatattgttgcattataacttcaattgaatacccgtttaacacgtgaagttttctaattcaactcctttatgtttccatttttatttcttggaagttttcatgtaaacttcctaactcttcccacctaacttatccttttattctgagaagcaaagccccaccttagcaatctatgactgaaattttacccgtacgtgagccttatcgctatgcacgcatcatgactgaaactttgtccttcaacttactcctcctgccaagtctcgcaactattcacgagagtcgaggtgtgtaaaacatagtctaataatagcatgtatatacaggaattagcttgtgcctaaataaatgtttttatataaaaataaattagtccgtacacaggcatagcacaataattaaagtttgcaaatctgttcagctgggaaaattgtaggggatatattcttcttttctaattctttttatccaaaaattgaactcagatatgaaaaattttataacttatatatgcattcggtttaactaaccgacttaaactcggttaatgcattcttcttttttcttaattttgctgaaaacttttgatcataatatgaaataagaagtggccaataatatatatactgggaaggtggtctctttctgattgtgaaactactaagttggtccgtacgtaaatggcttacttgaatggagagagaagatattacattatagcttgtttatatggctgtatgggcagggta

SEQ ID NO: 6575 - DNA, 1591 bp, Glycine max
  Soy_ogl_2947 Gm09:23215..2325266 Cluster 30
ataacaagcaaaggaacagattttagaagttgctatgttgaatcaagccatctgctgcaacaaccttcagacaaactcctttaaggtaattgggcctgtgttggtatcaactaaattgttatcatactctttcacatcggttgtgtacttttttacatcggatgtgtattttgtcatttggccaatctatcacacactattcgtattcatacaaccctctcaaggactgaatttgagcaaatatgttgagatgttcttgtgttgaataatgtgcagtagtattaatgttagtcttggaaattatgttcatgtacctagagaattacatgtatttagaaaatatgtacctaggtaatgagagttcatgcactagtaaattaatgctctcttggaagttccattgtcctctataaatatgtggagtcactagttgcattattaagccaagccaaaccaaagttgaaataaaatcagagaattattcagtcccaaataatcttcctcttattctattttctttgagttttcacctctagaataccaccaaacatcttgacaggtaatgattactgataaatttgaattgcgccgagtttgaatcgatgacacatgtatgatttcgatgcttgcgctgaagctgaacaaactattcaggtatagtaatactacttgtatgaactgtgtttaagtttcaagatatcatttgaagaatcattgaagggtgcagaacgtactctcatcaacatgtgccccaattgtttgactggcatgtacccacgctccatacgctcttcagaaggagtcacaatttcacatgaatatttctagatgtttatatttctgaaatttctcatatctttgtagtatcttttacttatttgagttttgtttagaatatcctgcggcttctttgttaaggccaattgttggctgtcatgtctttgtgactttatcattgtatatatgctttttttcaaccaccgtaattaagacatttggctctccggtggaaccttaaagtatttttacaaactttggttctttgaactaactatggaactaattattgatccaagacttagtcacacttaaagttcctcactcctttccaagaatgtattttacaggaagtgcaggtccttccctgcaaactcagtgtgggttgctaattgagctacactcattggatatttatgttatgttattcccaatgaatatttctagttgtttatattcctcaattttttctcttccttgcagcatcgtttacttctttgtgtgttgttcagaatatcctgcacttctttctgaatcaaggtgttcctgtcatagtttttgtttctttatttagttttgatgcacaaggtcttgaatcttgatctcttttcaaataatgcaatagattactaatgtgatcaatctccaattttaacagttgggaaatatcttaggctgggttagttaggattagaattacaacgtatgatataagcacaaaccaaatgcattaaataatcaatagcctctgaagctgggggacaaactgtcaagcaattaaactgcagagtaaagagttcttctgaagctgcac

SEQ ID NO: 6576 - DNA, 1100 bp, Glycine max
  Soy_ogl_994 Gm03:40022901..40024000 Cluster 30
caactaactatataatcagttgtaagagtatatatatacttccaacagacgcacacttttacatgctagctacgcttcctcaatttttccttacgtaattgttgtatgtcgtcaaagtgattcatagcaacccaattacatcatgaccttgggctcatatgccacgcagacataggataactgtacatgcaaagaacaaataggtagtagtttagtttcaactttctactactctgtctctgtcacatcccttccatgcatgagatcaattatatttttgtgcatcaaattttccagagacgatatacgggttagaactaccttccacacaaacatttgtaccttccaagataccaattcattagccacctattccacccacaccctagctagcatcctccagctttacttacttttattaattatcctgagtataggttctggcagagtagtagaaagaatattataataagttatgtaaatacatgtagataaaagtacaactagatacttaatggacaagttgtttaaactttaaaaaaaaagtgattttcaaaaaaatgtcttttaagaagcaaattgcttctaaaaaaacagaaaattgattcttaaaaaaaaaacagtttaattagacaaataattaaaaaatagaaattttttatttgattaaaaaaattgttaaataaaaaaaaattaaaacaaatagaactaatagtataaaagaactaagtactttacactcaaatgtgaaacaattttttttagggatggtgaatgtttcttctcaattattcatattcttatataataaattctgaatcttaatttatttattttaatgtggggtagctttttcttattttccttttcattgtatataataaattctaaatcttaatttatttattttagtgtgggatagctactcagacacattatttcaaatatatatatatatattatggattgaaatttgttgagattataagaaatttgagatcaattgcaatgtaacaaaaaaaaaaaaaaccttccgtgtaggcaatgcattgggataacgtgcattgtttgactgtgattatatatccaacaaaaattgt

SEQ ID NO: 6577 - DNA, 1170 bp, Glycine max
  Soy_ogl_5448 Gm17:1382631..1383800 Cluster 30
attgatttatatgacagtgtcaaactgtcaatttatatattattttttctctttttttatatctaaaggaatcaacgaccgactcccttggtatatattattttcttttaatacaatcttttcattttgcgtatttattcatttaatagaaatcaaattcaaatcacaatcaatcatacatttatgtttaaaaaaaattaaaaaatctcaacgagtatctttaaaacactaaagaaattgaaaatatattttttccagaaagaaactgctaacgtatcaccataatttgaaaggtattgccaacatatcaccataatttctctggtatttattttataaaaaaagaaaaatacttaaaggtacgaaacgattttcattcaaaacacacgaacaatgcctttcgtcaatttctcttttttatttaattaatatttgaattagcatttgttttgaaacaaatcacaaccattggatgttttatttcatgtaattcttgcagtgacttgtcgtactaaatagtagcactcattaaaacttatttattgattttttaactaatatttttagattactggttagtaaaactcatatttttttttaaaaaaaaaattgactgatttgaaaaacattaagattcataatatgatctcagtggttccccatctcccctctccatgcttgtctgttttttggcctctgatatttttggtattcattcattcaacttttttttaactaatatttaccttcaaagtattaaaaacatttttgggataaacttacatcattttattatataccaacggatctaacttcggttgagtaagatcaacatctttgagttattgtaaagtcttgtatttatctttaattcatgggatcaaaatatcattttattatatatctttatttattaatattttaaaataaaaggaaagggttatattttttgtttttccaagcactgaactttttgtttagtattttattttaaatgattaagaaaatggagatttttttgttgttcttaaaaacagaaaacgtcttaactgagttctgtttctcgttagcaacagaaaactgtgacttaggccatcgttaatggttactcttgtgattgattccttgtatgattcggtattttatttataaatagaaacaagaaaataa

SEQ ID NO: 6578 - DNA, 1347 bp, Glycine max
  Soy_ogl_6997 Gm20:44731159..44732505 Cluster 30
cataaagtacatgatgcctcctctttaaactaatattaggaaatattttatcctagcataattcatttaggcgtattatttcagtactattatattggataaaaaaaattggctaccgtgagaagttagttagctcaatcttcttgctgtgtttatactttacaataagagttatgacatgacatcattgttccaaatgaatggtaccatatatttcaatggttttcagtgacttaaagtgcatattgcagctgactgatggattgcttcggcttattttgttgttttgttcccagaaaaatcacgttttggacaagagtagagaaatttcaacgactaacccaccaattaacttcttttttattcgcagaacgatcctcatttcaaaatatatttatataacaatttatataatgcatgagtaagaggagaaaaaaaaaattaactatgatgaatatgtcggggaaagattaaaaaaattataaaaattattgtaaatatatcattagaggcccaccagtggttttcttttcttttcttctttcatatataggagtatttaagtatagagtattttcctaactttctaataatatattttgcaaacattatttaacaactcagatatggtttagaaaaaagtaggcatttgatattaatatcaccttaaaattatagaatttttgtctatgctaatgacaactccatgcttttaattgtccaaataatatactctttgtgatcaatattcttaatgttagaatcattcagcgatgaaatttttataatatccaatagctatataaataagaaattaacgtaatgaaaagaaattaacatgatagtattatgggcaattatgtttttttatgtgtcattatgtttatggttaatgttcaactgagtaaacagcctgtatccagagtgagattgtgtgatgtaaacaagaccatgaaataccaaaaagaaggatatgaaattatttaaatggttttaaaatcttattcagttcaatgtgtttaattattcaccgacaagctaattgttagcggtatgcgttgcatgattcagaatataacgtagtatagtacgaacagattcatatctgaataatatacttgtatccatatattagcatacaatccatacatgcatgatggtttgaaaaaaaagaaaggaaaatgatgggtagatacctataatttagtatacacatggagaaataaagagagaggagaaactaagaaatgtaatatgatatgatagaaaatgagataaagttatgagtgttaatcatatggttataataattaggtattcatatgtcactagattttaaactgagga

SEQ ID NO: 6579 - DNA, 1175 bp, Glycine max
  Soy_ogl_3615 Gm10:47975801..47976975 Cluster 30
atacctcctttcaaaaaaaagttccaaatacttactctaaaaaaaaaaaagaagttccaaatactattttgtgtgccgaaagtttagtgttattttttttactttacataatgcatcttaaattagtcaacaaaacgtggaattttattctaaataatgcatttcttgtaaatgtttcactggtatatttagttttaagatttataatagtaataagcacgtattatattatcaaatcattataaatttttttgaacagtcaacaactcataagccatctttgttataatttcaaaattaattagttattataaaagtttgcaacctgatgataattataaaaatgaaccaacttatcatatttgcacggttttgtgattaaatgatttgaataataaattaacaaatttatcattttatactatcatttgataaaagtattatttatcatttataatattaaataagttaaattgtaattttagtttgacccacttcaattttttatacgtgatattgattttttccctcacaattttagtttacacattttagaaatattataattttagttgaattgtcaattttgcatgtttttttatattaaaatatttcttgatagtattttaaataaatatttgtatctaggtttcaatcttacaaaattgaagaccgaactgaaattataaattttttaaaatgtgaagactaaatttgtaggggaaaaaataggaacatcaaaatcacgaattaaaaattaaaaaaaaaaattaaaatttacaattcgaccaactaaataatatatattgttataaatttattgataacaatttaatttattagctccaattattcaatatactgagaaattaaaacataaatctttttgtaaatattttatcattatatatgctgattcttgctttctttggagttttgagtttttaaggtcagtttttaacagtgtttttacctccagagaatttaaataacttttacctgagcatttgctttcacaacagtcatactgaataatttatctaacaaaaataatagtgattaagcatgtttgcactggcgcatcactgaatttggatcctctatactctgcaatactgaacgatcctctccactagacatgagaaataaccttctacctgcggataccgttccga

SEQ ID NO: 6580 - DNA, 1400 bp, Glycine max
  Soy_ogl_1876 Gm06:8984501..8985900 Cluster 30
taatcctaaatagggtgggtacctagatttttttctctgcgttctctatgagtccatgatgttaatggacaggtaagcaacttaattaagaaataaggttacaaaaaccttaaagtaactaagcaccacaaggttacaaaaaccttaaaatacctaagcaccacaagtacaccttcactattgcaaagcttgatgttattggaggattgacgcaatcccttaaagctgtaaagtatgtgatcatttctccctttgtgtttgtgttttttttttttttttttgtttacaatcctttgagtttgatagaacaaaatgtatcgctttttcctttttattttctttctctacgtacataggtgcatacacccaagagaaacatgaaaatgattattgattaacacccacatctacccacactgggatcaaatgcagcaggtatatattattcagcactatgaaaatttaattaattggacccactaattggattagaaaactgatgaactggccaagtataagctgattcaaataaacctaaaagtcaacatgtagataaactagtcaaagaatagaaacaatgatcaaatcaacaaaaaaaacgatttacagttagtcaataaaaattgtttaatacattgtcatttttatttttttcttgaaaaaacaaaaatcaacctaaagtattttttattttattttcattttatatgtaaatttgttatgactaatgaacattgtgatgcaagtactattatgatatatttgacttgaacttgtgtgtgtacttttttatggattttgtcattttgtgtttatttttaatgtaaagaatatacaaaattatggagtctttttagttttgaatgttgtaaaactacgatattatattctgatattattattatcatattaatatcagtttagctataattcaacaacaattaaatcattaaactttgaattagtgtattgattggttcaaccaattgtttggtttttaaatataataatttttattgttgcttgtcagaccatgtctatctgataattacttttttgaccctgactcaatgggtcaaggctaattagtgagccgggccaaattgacagttttacttgctacaagacatatgagagcctcgttgcgtaaaataaagatgcatttgatgagcatcttgaagtctatttttgagcactctgaattattgaagctgcgtgtgtgaaggattctcttgcccttgccatgtgttgttaatttctcgcgttctttctctaattcctcttccatctcacttgctttactttttttgttaatttaatttgtttctcttcctaaacaggagaaagattgaagggtagctttgaaagtcaccgaaagctggttttaagaaagcagtaag

SEQ ID NO: 6581 - DNA, 1188 bp, Glycine max
  Soy_ogl_6781 Gm20:36125601..36126788 Cluster 30
aatcacaccggccatcttcagctggcatgagttccagggttggacattgtaatttgcaaatgattacgtgcacatgacagcttagataatgtgtctcttcacgtaatataagttgaatatgactcggggggaagattagaagaattttcatagagcttatttagaaattattcataactttaatattttttaattcattttaacaaaatgttggtaaatttgttaaaataaaatttaacttattttggttaaattcataattgcaattttgacatgtataaattcttgtaggataaaaaattattaatttataaaattgtactgatatttgcaattgttgcctgtatagagctcagaaaataattatgtgattttttttttcttttaagaaatatccatgaacatctattaatagccacgaatacaaaaaaaaaaaaaaaagttttcaaatggatactcgtgtgactgataagatagatttttatcatgaagatagataacgggtagacgtagttattattcgtgtctgtctcgtcttgttatcattgttacacaaaggtattaaaacaacaagttaaacatgtctttctatatgtaattgattatatatatttcctgattacgtatcgtagcctaaatgtttacttcatattgttttttcaatatatcaatattaactgtgaaaccttttgagaacccaatttctagattgacaatggtgataccaatttaatttttgaatcttaaatattcagaagtcaaattaattcatgactaatttctttaccaaaaaaaatacttgactaattgggttaaataaatttatatacaaaaaataaaggtcttttaggttttcttattaataaaaggtaaacctaagattttacttttttttaccacctaaaccaatgaatattaaaactgataaaaaaaacctcaataaatatgttgttttcaatctacaaaaaaaaaaatgttttcagtcaagtgcatttctttgatcatcgttacctctttcaacaatattgcctcaatttctcaccatcatctgagaaagaaagagtgaaataacagccacaggcccacggcccacgaggttatcatttggcacattatttgaatcagtctattgtattataacagggagtttacgtttttttcttaacagaacagggagtttacgctaaa

SEQ ID NO: 6582 - DNA, 1100 bp, Glycine max
  Soy_ogl_4952 Gm15:9436301..9437400 Cluster 30
atacatttcatttcagcattattttttttaaaagttacattgatctatttggttttttgtttgtttagtttagtcaatattgttatcaactagagccatataaattaacttactggtccaaaaagcttcaaaacatggctgatataacatgtttcatcatgaactcaacgtggagattggagaatgaatagttgtgaaacttatggcacgagtcatttaattttaaaagttcaatttcagtaaaacccaaccagaaaaaacaaacctttaattgtctgtacaatatgatattcttttttttttagtataaatcataccgaaaacatgcttaagtcggacaagattaccgtgaatggcaaaactttgttcaatgaagtttagaaaattaaagcttacaagttgagttatgactgacaacttttgaatcttgaaccccaaataaggatagagttatgtgtcaattgagaattaataatcaactcacggaacgtgagaaattggatcacaatctcagaaacggacacagacattaaagttttagcataatttatgggaaacactttgtaaattaaaatttactgataccattgtgtgatggaacactttttaacctttttaggacattattgtggccttctaaaccaatgcaagttgagcaagcccttgcatatgtttctacttagccttctttcaattttcacttgactaaacaaatgcatagggcaaattaagtatagagaaaaacaaagcagatctgaggctccatgtattgaggtgcgagctacttaccccctgcccacatgcagctagctctatctgtatattgaataaaaactagcagttttatgcagtggtcctctccccctcattcatattaaactcatcactatagtttctatgattaaatattactgatacacactcatattattatatgaccagctaccaaatggaagcagcattacaattagattttgacatgtggcatgcatgtgagtcttgggcccctcaacataatttacttacaatagttattttttttataaaaaaaaactttgggtctctgcaaagtttgaattgttttttgttttactggtaga

SEQ ID NO: 6583 - DNA, 1134 bp, Glycine max
  Soy_ogl_1714 Gm05:37709288..37710421 Cluster 30
gttttaccgggcattctacatactagtttttcttttaaaaattaaaatccacatgatatgacgtggtgagtgaagatagatgtttccttccctgtcacatcctggctttcttccacgcaaggaaagtctgtctcgaagttcttccatttgttcccgtagagcaaatataagacaattattttgctttaaaaattatgtaagagcaatgatgattgatgataatgaataattccaaaatcatgaaaattttcaaatcccccaacccaaatttcacattctaaatatgtgattttgataatgtataaagaaaattgctcaatttctaaaaacaaaaacttgatctcgttgtctcaattcaattgtagatgcatgcatgggttgatgctctcttgtctgtctcttatataatttatttaggttgctctgtatatcgccgcgtgcctcattttcgggtttagatttgaccaaaagttttattctgtgctatgggtatgcattaggtgaatctcaattattcgcataatacatgtagccttaggtctagcttataggtatatcattaaattctttaggtcgttttgtttttgtcataggtatgcctcccgtataagattggtcatgtatgcttacttgtgctactaatatattttgagaaatcttcttgttcattttttttttttatcttaaatggagaatgtcttgtaaatatctgtataattaaattattcgtgatagagcagaatatggatattcacgagtggggttgaaatcacaatactcctcatcctgtagttacctataattatgtaaaaattattttctattaattttctatatagatgtattatatttttaattttatcattttgaaaaatgggatactatttcttttaataattgtatgatgctaatgttataaatttgtaattttaaattttcacaaatatttatgatttttttttatcggccacaaatatctttgaatatacctgttagccatataaatgtctctagattaatggaaacaaggataaatacgaaagaaacattgtccatatccattcctttcatttgccatcttcatgtttgttctgtagaagtggaagaaaataatgccgattttgtttcataata

SEQ ID NO: 6584 - DNA, 1322 bp, Glycine max
  Soy_ogl_3212 Gm09:161501..162822 Cluster 30
agcattgtatctggtttttcattattttaaataattttttttaaaaaatctaatgtgatttatcaaacattctttttcattaattcactggcttggctcctgtgtgttggtgaaaattttactgtaggcattgcttgatcactacatccgtaaccataaatggctatcaagtgtgcttaccctgtaacatgaatagtgataataatcaaaatcgattaagcatatgacccagaatatacttatcatcacgaatttgaaaattttatatgcctagctatatatattgtgtatgtaagagatggttatgatgtgagttgtacatgagggacccaagcacaggctacagcacatatcaattatgatgactttctttatcacatgcctccaaggtttatgaggattaccaagtaagctaattagtgaactataaatctggttcatgatgagctttctaagttaaatatttagtatttaaagtcatgaattttaatacttgtactaagatatgtttataagtatctttttacagcagaaaaaaaaggagggttctttttttttctttagtagatgaaccataaaacattttgcaaatttgtataaaattgtattttttttcttaactgacagagaacgaagacaaattcagaccccaaaaaagaagaataaaggaaaatttatttagctgcaattggatgaatccaattagacaaagatttgctgtgtccaataaatattacatggagatcaagaagggaaaaagtagctaggattttctatgtttatgtatgaagtatcttttctctaactaaaagtagacactttgaattgtaagctggaatagctcagttggttagagcgtgtggctgttaaccacaaggtcggaggttcaagccctccttctagcgtattatttttataatatttgtctctattttgtgctataaaagcattttcccgggtaaaggcccatgtaggcgcatacctctgttcatgggtttagcccaacttgaatgggctatgttcgaatttttttctttctatttgatagttactatttccactcccactcttcgctcgaacatgatcaaagttcgaattctaattttagttttctcaaacaggctgactaattaaatcaaataattaaagaaagacataaaacggatttcgaattttttttaaataaaaaattatagttatacattaatttttctacaaattaaaaagagatgggaagaggataaaaaataactaaaatgagtaatgtaacaataagaatgtatcataaaaatgttataagattttttttataatatgcgttc

SEQ ID NO: 6585 - DNA, 1100 bp, Glycine max
  Soy_ogl_3552 Gm10:45419601..45420700 Cluster 30
tgtcaaagagtcaattgatatttatagtcttatccatgaggagtactgcaagttagattttaaacagtaatcgcatatggcatttaaaagtctcgttatgaatatgacatgcttgctttttaattcagaattcttgtctaggagtaaaaaaaataaaaaattaatccttcaatacaaacagatttatttaaggagataatttcttccgacaaataatattgtataaaaattatacataaaatttgatatcgaatgactacatacttaaagaatttgattatttattaattatatcatactttattggtaattatataaatctaaaataacttaaaaatacaaaaaaaaatattgaaaatctatataaaaaatttaggttacaacattaatattttttaaaaaaaaaatgttatgtacatattaaaatgtacatattttttaatcatgtttataagtatcataagaatatcacttaaagaaataataaatagttttttttattttatttaagcattactttgtacaatcttctctttttgcggaagctctggctgccatcatagtcttggggattgctaaagacaaagttgacatagtatttggtttcaacctgattctcttttgatgattcaagccttaaaaaaatgtgtctctgatttcatagtctctctgtaggcggtgactcaactgtctctctttttgtaatcacatacataacttttatatattctcacgtatatagagaaagtaactcttagtgctgataagttgataaattgttgtggacattaataatttacatttcagacataacacttcaattttgtaagtggcatgtgtcttcctatctaagcaaaactagatgcacacaaacagcccgtaatatatcgtattaggcttataatacagcacaaggacatgaattctgcttcagaagatgacgcatcaattgtttgcaaagtccatcacttgcgaaaataataagagtccttgtaaaaatagtgtgaaccttcttctattagagtattgtatggtccatcatcacttgatgagtgttgtgtagtccatcatttgcacaggatatgaaggacatctgagat

SEQ ID NO: 6586 - DNA, 1500 bp, Glycine max
  Soy_ogl_3818 Gm11:10146701..10148200 Cluster 30
aaaacttaagatatactcttggatagtagttatttagcaaagagtataaccgacgtgggagaaataataattaaagaagatggaggtgagatatcgataatgttgcaattaagtaataattaacttggtaaaattaatggggataaaaattactatgacaagtaacagcgtatagaagacatatatgttgattaaaatatatgccttctaaattctaattaggacgattattcttccccattaggcaatactattaattaccttattttaagttttaagtaagaaaaatatctgaatatattaatctacttttttattttctggtgcatacatactggtagatctttccgtagtttatgtaggatacttttgtacatttttacgactggaagcttgcaccatatataattaagtaactcttgatccgaagtttattgccagagacggttaatttttatccagttatttcaaacttggaaagacataaaagtaaatggaagatgcattgccccttcccacataatttcatttcgtgttcaaacccgtggcacaatattgctgctatatatataattaacccaagcagcgataggttgatctttgataaaaccctaaggctacctagtatagttttaattttctgctaatataatttcacgtcccttccaattttctcgttaggctagaaacatgtgaaaattaaaggaaaaatttaaccattctatccatctcataatgttatatatataagtggagcaatttttgcgttgaggtcatgtgcagttcaatgacaagtataaatctatcccattcttattgatctgcgcctaaccaaacttctatggagaaacaactgtaattaacatcaaccctggaagatatcatatgtatcaatatatacctatataggacaatcaatttccaattaacaaatatagtgtcatgaattgataataatgaaatctagatgtaacgtaaggtgaaaattaaagaagtcatgtccgctgaaattggaatgcactaatgtaatatgaattaaatgggcagtaatagaaaattacaagcatggttaatttaatgaatttgataaaattgggagagaaaaaaataacaaaaaggaggttatcaggtagttaaagagactaatcaaattaaagagagacatgaattcaacaagcaagcaacgacgtgctgatcgaagtatttttatagtctttttgtatcaatcaaatcaaatacaatacattgcacaatacatattaaataatattttttttaggagaatattgaatagtattacacgttcaacataaaaataaagaaataaataacattacaacatgtctttccacaatcaatctacatttcgacaccaagaattttttatttacaaaatattacacgagctttcaaacacgcaaaaatccatttactgctctatagctagcataaaaaagattagttgcagggtggaattgatcaaagagtctattagaacaa

SEQ ID NO: 6587 - DNA, 1100 bp, Glycine max
  Soy_ogl_1480 Gm04:47910301..47911400 Cluster 30
aatgaagcgtagaaatcaggcaattgctctcaaggatttgaaaggttgtcacttgtaattgtccaagaaaatgaaccttgcaagaagggcagaacgtttcgtcgttgatggtgatttcaagaaggacaaaaccaaagcgatatatataatttattgaaaaatattcttattcgtagtcttcgcctgggttttaggcttagacgttaatgatcaaactaatatacaatagttaacttggtcttcgtcgttgatggtggaatcaacgattaatgaagttaactacactatataaaagccagatattcgacataaaaatatatgttaagaaaacagctagctagcagctttattaaacatgaaacatcttaatcaactccatctaatcacttcttcttcttaaaaaaaaaaaaaaaacttcatctaatctcaccatgctttggcaaatgcatgtcatgtttgcttctctaaagacgtgtttaattaagatttaagacgtctattaattcaattgtaagagcaaacaaggtataaaaactgttacccttaaggttattagctaagaaaaatattttaaaaaatatcatattaaaaaatacaaaatttatcgagtatataagtattttaaatatttagagagattattaataagattctttagttattttcaaaataggcatcaaattatacatatgcttttaatatagcaactattttcattttcatttatacttttatttctttaattaataccgtaagaagttttgccgcccaatatctacaagcattaggagacatgatgaatgttgaggagcagcaatttgaacaatcttaacctcgaaatcagttaagtgataaatagacaaaatgccccttttttttattgcttcaagagaattataaaagtttgtcccccgccgttaagtgctatacacaatagcatataccttaaaaaaaatattagtataagaagcagaggtggatacgtatcatatgagaaaacgaaacctaaatataatctcaaaagaaaacaattatatagaacgacaaaatatatatgatatcgttttagtcatttatacactactagaaatatatatttc

SEQ ID NO: 6588 - DNA, 1024 bp, Glycine max
  Soy_ogl_5268 Gm16:3317777..3318800 Cluster 30
gagggatgatcaatatcaccatcattgttccaaaactggaattttctgctccatgtgggataattgtttgttcacactgtagtaggcaagccatctcaagtatagaattggcgatctctggtcaaaattttgcatcattcattccacaataaactgatagcattatctattaattggacccatcattttcataatggaatcccacgtatgtcaatatatgtcaccaattaccttggatgccaacaagtagattttttttttcttttgtcacgaaacggattatatatacatggtatttattaatttgttcttaattaatgagtatcccagagactttgaattttgtactgattggaaatctccaataattggacattcttggcttcaatgagtaaataatggatttaaatttatggttaaataaatttttattttctcaactatttcaaatttttatttatagtcctttttaaaaaatttgttcattttaatttctgttaaattttgaatgactaattttagtccctctaataaaaaaaatagttcatttttagtcttttttatttactgctaatgtttgctaatgtttgttgattacttttaaaaatttattttaatgaatcggtaattaatcatgtacttgtagcaggattttttattcattattttgttttgataagtctatattaagatgcaaggactactctaatattgtagatcacatgtctaatgacattgtttaatacagttaagagaactagcacaccaatcaaaagaagaaaaacaatctgtcccactataaactataaaagagaaacatgaatatgagagtggactttagtcatgatcaacattactgataagtcataactttataaagtaaacaaagagatcacaccatctatttaattaatcgatatgtagctcacttgataattcattctaattttgtagaaagagacatgtgtttgtttctcacataatacatctttaaagagaaaaataaatttttttaagtgtaatt

SEQ ID NO: 6589 - DNA, 1100 bp, Glycine max
  Soy_ogl_6623 Gm19:49325201..49326300 Cluster 30
ttctgaacatataactgatataagcattatgtgtgtgccaccagtaaatagtagataccaatttttatagataacatcaatagcaataggcacatcggagtgaacaaaacaatggcgaatgacaacgatttctgtttttaagaagaaaaaaaaaacaaataataaaattaagcaattatgccatagattgcaagaatggcaaggaatttatgttcctaatactgccagtaaaatttgatgtattggaataaagaaaatccaagaaaaaaacagtttttttttattcggaacgaaaatgaaataaaacaataagacaaaactgactgactaacgagtcgtcgtggaataaaaggactagagagatgggagactagggatgagatctgaagactgaagaaaattgttaggaatttggaaagggaaatagaactatagaaggataaagagagcgacgattaatgaagagagaaaagtggaacgaaattgagtagacacttactaatttaggattaagaataaggaccacatcttatcaacaaataatagtatgtaataactttgtgtagtttggactagatcggttctcataagccagaaccaaaattcaatccaatcaaaattttgccatttttttgtttgtatttttcaaattttttggtttgtgaattttcagtttatcatttttggatcggttgctgtggttggcatcagtttgtatcggtccatgaatattttagagcatcatgtattatgggtcatataatgtcacatatatataagagctcttaatattaagattgtcaaaataaatgcttgatttaatttgactcatttttatgccaattcttagctttaaaaatattttttattgattaaaatagttgaataatgttatttatttaagcaatgatgcttgtataaaaaacatcacatcagatactcttaattaatccctatgtcacatgaaagccaacctaaaaatgtactcttaattaatcacaaatcaccaattcaacaaaaaatgttattgattagtttagggaacttttttttgaatgaatgtcaatctagaaactaaattaagtgtgtattaatgtgag

SEQ ID NO: 6590 - DNA, 1300 bp, Glycine max
  Soy_ogl_324 Gm02:2314201..2315500 Cluster 30
taaagaataatatctaatttttttcccaaccattaaaaaatgctatcccagattggggggaaaaatgagggaatatgttcatgccaatgttaacccaaaaaatgaaaatacccgtgcatcttaagaacgactgtttgaaatcacgaccaaaacaaacatggtagagattctgacacgtactttagcccaaaaggagtggctttatctgtagtggatagaaaggtaaaagaaatgatgtaaacaagaagatgaaagtaggaaaaagataaatacatagatgggtagatagaatgcacacccactactagaattttggccacaaagtcttttattacggattactagctgcacttgcaatgtgcatttcgttcgatctatgtatggaatcaagagaaggcctttagacaaagaagatgattaatttgggcacgactttcatgatccctgcaattaaggaggttcaactcttgcaagattattgtcgagctttggtggatgattatttaaagttctggtttagtattttgtaaaaaaagttctttattttaatcttttttatcttttttaattcattttttgctgtcaaaatgttagatatagtgatagttaaaataaaataacttttagcaatcaaaaaccgttatatatataattgacataaaaggtactacattaaaaaataaataaataacgcaaaaaaaaatcaactaaaaaagataaagtaataaactgagacttagacaaaaataaaagattaaaagtgtgatttaacttttttttcccatgttagaatatagttagtttggtcgggtagacacctgtgaaattatgcagcaaatgaagtagtctatcctcaactccttctatttctaattaaatgtatacataacttagcaaaaacaccttcttttagttgataatatttttctctctttgttaatggctatgccgagttattatcttttaataaattagaaggaaaagatatatatttgaatccaatgtgtagttgcaacgacatgactaattaaatgtgtttatctttggtcacgaagactcactaattagctattatttgactctttctatgtaatcaagcagtataatttctgtatttgtgtttggatctatgttcatcagcacttgatctataggttaaaacagaagctactaataatatatatagcttctggacgggttcttgggtgtgtagggaaaattcactgcgaaagttattatatttgtctaatttacttatccgtaatctaatggtatattttgggtatgcaaaaccaaaaat

SEQ ID NO: 6591 - DNA, 1000 bp, Glycine max
  Soy_ogl_5847 Gm17:41586601..41587600 Cluster 30
gttttgtatgagaagatcaaagctcagttgcaaatgcagaagctaattaacactttattaattaacactttattagtatctatctaccaatctacgcatctcttgttttttttcttcgatcttcttctctttttacaagaggaaaggccaatgccaatgacttgtttaccgccaatgtttttgaatttggggtgcacaaaaatgaagttaattaatttcttttatgtaatgttatattcattatgataagttccatgacccttctgtgaattttctcctcatgagatatcattgtcctactcacatgataaaaataaatctcaacttgtgatgcatttggtcttgcatgtattgtagtccatgaccattttggctagctatggctttaattgacggctgctaaatataggatttaaatcacgtgtctcaattaatatcctaccaataaaaatatgacatgtaatttaataattggtaatggaagataaggatggatggaagaaaagggataatatgcgaaaaaaaaaacagagaaacacacttataaaacttttaaatagcatgacatgtttttattggagatatgaattgaaacacgcttataaaactgatgatttaaatccctaaatatataaaatatgataaatgttgatcaattcattttttaacagtataactattttattgagaaaaataatcaatgctggtcttgacacatgctacaaataatacaataaattgaagttagattcaattgtgttgggatataaatatgagataaattctcacacattaaataataatgacatatataatattaatgaaaggatcataaacttaaattttatgattttatgttaaattatgatatgtttgagatccattgataaaaatctacccacaaacaagttgtattttggttagtttggcaggggaaatgtaggtgtctattacattatgtcagcacctgtattttttggttgaggagaaaaattgttac

SEQ ID NO: 6592 - DNA, 1200 bp, Glycine max
  Soy_ogl_6915 Gm20:41831901..41833100 Cluster 30
catcaccatcatgggccagcttcagagcccatatctacctaataaagtctcatctaaaaacaaatttatttcaaattttcaatgtttacagctggagagaacaacccagctggttaatatacaaccacagcaagccatgttttaaatgctgtcttaatgctttttagtttttttttttttttcctgaggaaatgatgctttttaatttaaaactactcaactttaaatatacatgacataacataaaattttcctagattgtcatcttacgacactcctcattttgcccgcaccatatcttttcttggtccctcgtgcaatcataggtagaaccgtgacatagaaacttgacaaacttgttatagtaaagaatataaatatatgtaagatacaggacagtaggtgctataaactattgcttagcgaataaggtaaaattgtcatagaacaaattgcttacagctgctaattaatccaatataataaagtaaccactgaaggaatcaatattttcagctaacacacttgattaattggtagaagaagaaaataaaagtggagcaattaaaggatcaaattggtaactttaagaagtacattaatattgttatctagcatccattcctcttcatattcctggtacttttactcctatcaatcaactcactataaacaaattatttcccttttgtagatttaaagagtacaagaaaagtataaagcagtatattgactagactgttcaattttaataaataaaaaactggaaaaaaaaattataagatcaacttaatacatagatacccatacgtatgaggttaatgttcatccgtaacattcggttataagttctagacaaagcataacaagggaacaaagaattatttttaatattttctttcccttgataatatatttcagcctgtaacttgagttttaaacctaaccatagtttaatcagaagttgcataaatatttaaagaacaagagaattagaagatggaagaatggctcattaacttaggtctctctttaaaggtcttttatgtctttaaccacttaatattgaacatatcagcaacattagtgtccatggtatagatgtttcaggtttactaccttcttctagttgccatcaactgaagtgtctcactcaacaataataaccttcatctaccgattgcattttaattgttatgc

SEQ ID NO: 6593 - DNA, 1031 bp, Glycine max
  Soy_ogl_1587 Gm05:3853601..3854631 Cluster 30
ttttgaggtggtacttaagaacggacattatgtacttgaccatgttggaaatttacttctatatatttttcttctaatgattcatttttttaaggcatttgagaacttcaaaatgcagagaatgttaatgtcatgtgaatattgaggtttagtagcactctgctctaactagaattagaatttattgatcataggcatcatttttgtatttttcgtgttcaggagcacctctatatataaaattagagagatcatgggtgtgactttcgatgggctacatattgcatttcaataaattacttgtaatgtattatttttttgtaccaatgacttgtgaccaagcacttccaaaatatctaaatttataaaagacataatggaggagggcagaacatttgggtcttcttggattcgagagtattgattcatggtagctttcttgtgttatttaagttgcgacctgatttcgtcatttatgtctataacaatacattggtttgcatcttgaatttcaatatttattttttacttttgtctatcatggtcagattttaatttcaagtgatttctaacatgaaaagtggagtaaaattagtcgggaaatattatcataaattatcaccaatttgtaattaattgtatagttgcttgtgtagtggtaaatgttgccttgtgtatccatcaggtcgcaacttaaaaaatattaattattttaacatgcaaaactgaaactaatttttgttttaaataataataactttaaccgttatcattaaaaaataacaaacaaacaatttgttttatataattttattctagtcatcagtttaatcattataataataataaacataactaattttacactaactaatcttaataattattataagaaatatgaaaccaaccttccgtagtgtgaatcagcgttaatttcctaacaaaatataggaatgaaagtttgtatcggagacttgagtagactcagcaaagttattttcagtaagtatttgagctcttttttaattttt

SEQ ID NO: 6594 - DNA, 1000 bp, Glycine max
  Soy_ogl_2627 Gm08:12133701..12134700 Cluster 30
taatcgatagtgcaataatttccaaacaaccaaaacaaggaaaagaaaataaacttaaattaaacaccaagaaaaataattaattgtaattagtttacaggttttgtttcagaactgaaaaaataaatagaagaccatgctagtacgaaggggaggaaatatcattgttcgtaaagaaagctccattgatgagtttttattggtctctcaaaccaaatcatagaacataaatattttgtcttgataattaaatagtatggagttcgtacgtgaacccacctgcaaaggaagttagggtttgtatatctttacattgttttttttaagtgcaaactcctttggttcttcattcttccaccgacgcttacttgctgaccttatcattaatcttgaggaaaattttcttaattaaggaacattaatgtatacgtagccaactactgcgtgcacctatccaacaattattaataacaacaagagtgatagtaaatagtacgaaataattcacacgaaaagcacgaaaacacaaatatttgaattctattgaatacaaataatatattaaaaaataaaaataaaaaagagtcaaaatacacagtaatagcaattcgttttatattatttcgtatcaacaaccaatttcctaataacaataatgtcactaaattattattaattattctcttcctgtttcacattttctcaacttacctccactgtaaaaaaacaaaaaaaaaagtacctcctcaatgtccctatatttccttacatgttaattacaaaccacaagtctgagaccatatatagttaagcaaagttaatgaaatttaaaattttttatttacttccaaaatttggggagtttagtgacaaaaattgagaaagtgtaaattttcgtaatgacaatatcaataataatgtaataacgatggtgattaatttttgcttatgaattatgatcctagattactaatagtaatagatatgttgagaatgagta

SEQ ID NO: 6595 - DNA, 1082 bp, Glycine max
  Soy_ogl_4562 Gm13:38896719..38897800 Cluster 30
tctcttctggagtcaaaaacttaaagcatacactttgttcaaagtcacttgattggtccctcaaacaaaaactgaaaaaagtagggttgtttcattgccttcctaataatctttgcaactctactaacaaactcatttttcaagcctctcctattagtatttacaccttcacacatccaactaagatctattatttatttggaaacatggaattacagtccaacaagagtattatacaaattttttaaaaaaatcagcagcataattcctatattttgaacagtttccatttgtttttttaaaaaaacatgctttttactaacaaacaacaaacgcatgcatatttctccattaccagtacataatcaaacactgtatcttagaaaagatcacatcaatcggtacatcaagtaaaacacatgcgtaattcctaaattatcaacacccaatttagcatcttatatctcagacagaaacatattgagttttggtctccactaacaaacaaacatatgtataccttctaaaatactagcaaacaatctaacatttttgcatcttagacagaaacaaacttgttattttttttctctccactaacaaacaacacatcaatccacacaataactcagtctggaccatgaacaaacttgcattaaagttttctcttttcttcaatatgttgtgcaagccaagtccttagccacgaactcaacatgttatgtgagaattgagacctacctaatgatgtgggtcaaatggtatcatatgtagagtttgagtaaatatttggtttgattctcacataacacttctttataaagggagagaagttttaatataattgcaatgaagcctcagacaaaaaagtaataccatagttgatttaaagaatcaaaagttataaaaatacatcaagattatcagagtaaaaggttctaattaggatgatttaaaaaaaagaaaacgagacttacaaacacaaatatatcttaaaaaattcttttacaattattgaattagttggtatataattggttcataataactgaacaacttacatgagagctcgataaaagact

SEQ ID NO: 6596 - DNA, 1100 bp, Glycine max
  Soy_ogl_914 Gm03:36787401..36788500 Cluster 30
aaagtggggtcatgagccaagaagtttttgtacttgaattggaaaagaaacatagcgcattgcattgcattagtcttctgctaagaatcaaattaattaaataaagagaatgagaaaaagatgcaatatgcattgtttccttgtctttctgatcgattctctatagttgatcaaatgcacttgcataaaagatcatatggtatcactacaacatgatctttattaacactttttgatctaacacttagtaaatatattgataaaagtttttagcctcaattaaaaagttaacaaaatatgaataaatattattaatatatttttgtgatattttattaaatagtgtgtataatttatgtcgttaaaatttttaatgacatgaactatatataatatttgataaaatgtcgtgaaaatatattaataatatttatttatatttaataatattttttaaatgttatcactaatattttcattaagtgttagagaaaaaaaatgttaaaaatcaatgtgtagtagtgtgttttgattattatcaattgtttgcctccccgtataggaattgaactaccatatatatatggagttgatcaattgatcatactcgtgaaatattccaggcttgatcactccctttctccttgacgtgacaccaaaaccatatatatcccgtcaaacaagaaaaaagaaagcaaagaaactcttagtattgttaagctagccccatatatttatcatgccacaatgtaattgaaatgagcaaagaaaataaagcaaaatacccggacaaatagttggcatgcatgtactgtaattggaaaggagaaagataaatgaacatcttaaatgctattagacacttagtgtgagagaaaaaatattatatattataaaatttataatgtaataagaaaaaaaaaaatattgataaaatatttaaagtaaaagaatgttcatgtacccgaaaaggaaaaaccttggtgatggacctagttatggggtaaagccaatccattgtattcaatggaatttaagacttcaacaccttgctcattaattaattgacacttgatggctgaaaaccttttattacaagc

SEQ ID NO: 6597 - DNA, 1094 bp, Glycine max
  Soy_ogl_1669 Gm05:34511501..34512594 Cluster 30
gaaatattttcatatgataagaaagcttgactcaatgaaagtccaattaggatagacataatcatgcacctacattattgaaatatgacgaaacattctgatacattatataatgtttgacccataaatattaagaaatactaatccataaatatattctcgaaaaaaaaaagatatagaatgtcttggtgtcaagatctatggagttctaaatatacttcaaatttctccatttaaaattaaaaaagtctatttgattaaacaaagaattagaaatttattgaattatcaaatgatacttagtgcaatatgatcaaaacatggaattataggtatatgtatatatacctacaaaacaagtaaaaatcacgaataattttgtaaaaaatatctttaccttaaacaagttaaacaatacattttattaaatgttttggattaagtggtctcttttacaagaaaatccttcgtggaacaattaccaacactaccattttgtgattaatgtgaccaagccaccacccacgttactcaaaactactacttaatcagcgatcaccgcctaaatacccccatcgacattgttgtcgtgccatagttacccccactctaccaacttgagtatgaagaagatctgaacacatattttctataaataaatattttttagtataattaaatgtaaatttagttatatcgctagcaaatgatatggtgcaactttaattattattactactattattttatttttcatcttatcatgtaggagtgcattctattttttgtacatttttacttaaagttgggattaaacccgatcaaagttgaatttattagcagaagctattcttcacaaaaataataaatctattttaaatttccgtaaagagaataatgaaaaattattttttctatagtggaaaatcaaaatactattactttcttaatataaaatgacatcgatatcaataataaaataaatattaatcatagtaaaaaaaattgaactgtaaaaataatatatagagagagtttaattttgataaataaaattacactctgaataaattaaaatttaatctagatgtaac

SEQ ID NO: 6598 - DNA, 1100 bp, Glycine max
  Soy_ogl_2881 Gm08:44268901..44270000 Cluster 30
ttacaataaacacttttaaaaaataggaaaacaaacatgataataagtataatattgattaataagcataatgtctctgttgctctggaatttctaatgtaatattatgcttattattattatgtttgttctaacttatgtctgttttcttatttttttaagtgtttattgtaatatcatacttgtaataataaaaaaggagatgaagactaaattatattttatctttaaatgaaacaaaaatttgcagtctaacaaattaattcaatgaaactcactgacattttagtccaatttatttagtaatcatgttcataattatttttgtcattttcattcatacgtgtcacgtagactttttcattaatgataatggacggaggttaacgaataaaaaaatttgtcatattttttcacttttgagggataaaattattagtattttatacatttaaaaacaaaaataactatttacactaaaatattttttatgtgtgaaaacaaggtattcttattgtcaatagtcatgagattaatctctagagatttaaaaatcatcaaagtgagttttacttctcttttataaagtttttttcatatgcttaacaaactcaattatttattaattgtactcaatttattggtaaagtgaaaagtttcaatgtggagttaattcaagatattatgggaaaaaatatttattattatcttcctgagatttttttttaaaaaatgcaattttttaaaaaataaatcagttaccaaacattcatacagttgttaatttagagaatattttcttttgcttaaatttctttctctataatacctttaatttaatggaataaattagggtattagtccctgaatatacatgttcatttatgcaaaatatatctaattagttaaagaaagcaagttaatatttccttataaagcgacttacctaacaaaagtaaaccatatatatacatgcatgtattcaattggttaacagaacactgatgaagaatcctaacaaaacactgatgaggactccatatgcatatgacaacacagcatgccttgaatctttctggatttggtttaaatgaggactt

SEQ ID NO: 6599 - DNA, 1500 bp, Glycine max
  Soy_ogl_6248 Gm18:58313901..58315400 Cluster 30
gtttttctagctagccacaccttctgggcaccatctgcacattttttctccttattctatggctgaaaggggtaacactgttaaattatttgaaagaggttttatacaagtcacatcactcgtgtagtacaaatcaaaatgtatcacgccatgcatgtaaatgtgaataattaatgtgtttatgtttatatgcaaccatcgctaattggtcaaattaaacttacatgaacttttcagatgcagacatacaaagagaaatttaatataaaagaagcacgatctttgggacattagccttagatcttatttattcttactttatactttagccaatgggagtacacatttaaacgagaaaagtaagaaaaattaggctaaatgacatgtcacggtcaataaacatttgaataggttagtgataaaaattaggccaaatgaaatgacatgagggaaaaaatctttgtatataatttgtagaggtcaagaagagtagtggaagacagttaagtaatgggagacacaaatttattaaatttgtttgttccagaaaaatatttttatttttataaataattataaaagattaccttattttcattttatttactgcttaaaataaaactacacaaccactatgtagttatgtactacgtaatatttaggcattcaaaaggtatcctttcgaccatgtatatactttagggacaagtttatgagatttatccctgttaatagcactctttgcattcacatataggaaacctatgaatgtgtgtgtgtgtttatacctattatgatattcttcgtcggaatattaattagtgccatttttgctgcccagattttctaaccacattattcttaggccggatgatctaaagcatagaaaaatgccactttttgaacacgccacaacacttgtattaaacagccgcggcaaaaataaaaatcttagtttcactctattaaatgggaacatgaatatctaattatacacgcagcctttgccaattgggcaagtgaaacttccatgcaatgagaaattaatataaaataagtactaataatctatagtacgtcaagtagctagatgttagtgagagtgagactacatggcatgctgtacatgtcatccaactccaaaattcaagacttaagaattcgaccataattaaatgaagagagtttttcgtatagattcagtcgaattaagtcatgcttatctctgtcaaaaaaaaaaaaagccacgcttatactacaatgacgtccacgtttaccttaaaattattttcaataaccttgcacagtcagaataagaaataacttttttataattactaaaataacttttctggaaatttatcatctggtgttgtaagagcttcaatgcatgattttcagatgatgaaaaattctctattgtcatccgccctcccaaagctgataccaacaaggacgtggtccggaacattttctctctctctcttttttttttgtggc

SEQ ID NO: 6600 - DNA, 1100 bp, Glycine max
  Soy_ogl_6291 Gm18:60086601..60087700 Cluster 30
tggttcagataaactatagaataattagttcattgaaaaatcaatgtaaaaactagagagagaaaattaaaggaggtcaatgaaaaatgtttaatacaatattttactttattttctttgaaatatgaaaaatcaacttaaaaaattatttatgattttgattttttatcttaaatgtaaagtttctattattaataattaataatgtataatgttgaaacttagacttttttaacggtagaatataaaaaacaaacaaaaattacaatcccaacgtagaaatcctaagaaaatggtcgacaaaatgtgcaagtatataaaggagtagttgatgaagggcctagtctcaccactcaatctgcgcatttattatcctctctataaacatgctggaaactttggatttaaatcatcagtctcattttttagccccaattcatgttccacaaaatgtgtaggggtagttgatgtcatgtgtattttttgttcaattcacaaaatgtccttgacagaattcctagcatcttcttaggttaatatgtaaatcagctcaataaatcagctcaatcagtgtgattcacaaacccgaaacatcaagcttaaaaggtgaagatgatctaactttattaatttaataccaatatatccatttatattatcacctgatcacatgtatatgtaaccatccaatcataaattactcctaacatttttaattagtaatactagtaaaactgaagggttaattgaaaaataagaagaaattaattttcacgtgttgttggaataaaaaaattgcattataaaataatttttaaatataacttttaaataattatcgtaaaaaattcactctttaaaaaaaacataaaacaatcaacattctcatacattataatttgtgaatagataacattataagaaatatttacactattaaaattgaatttaaaaaataattacttcatgttaatggcaagtatgctccagcatataattgaaaacagaaagaataaaaaaactctgttttctgatccttccagggcattctatagtggacccatgtccctcccccttttgttttcagctgcaatatcacc

SEQ ID NO: 6601 - DNA, 1626 bp, Glycine max
  Soy_ogl_6733 Gm20:33924624..33926249 Cluster 30
cttgagaaggaaagtttctcacctcatatatgaaaaagttttcgtgaaaaattaattaaaaaacattataaaaaatattattattttcttaaactgcataccaaacctaacataaaaaattgaaatttttaactcaagaaaccaaaactttgtctcccaccaaacaccctaaatcttctagtatttagtcctttgtcttgggcctttaatttggccctccttagacgaataataaaagattttggagtgagtggaaagaattttagcttccaaagacgagttagatataatatgtatttgaagaacctttaaaattatgataaaccatgataaactgtgtgaatcttaattttgatcaaaatttataaatttaaattattttcaaaatcaatttcttaaatcagtaacaataaaggtatcaattgatgatataaaatgtaagttttaatagcaaataaataaacaatatattatcttaaatgatggagacatggattacaacattctttctttgactacaacatccagaattccagattaaggtgactttccccattctaatggaaagtgatacttgttcaaaattctccaagaagaaaatgctccaagtagcgtatggattaagtttgatttttgaaaacatggaactttaaaacctgcgtcttttgtgctattcagttcaaagatacaaacatctcttatttgcaatacattctcccttgcaaacaagcaccaaccgcaagagatcgtgcgacaattgggcaacttcacactccatgattctccccaacttgcagcatcacaatcttcgtgttcccaatatagcttttcaaatctggtacatactgcataatactataataatttagaaacagaaccagggagtaggacttcatatgaatatgtaaatatatatgttccatcttatattgctccagattaaaaggttttatggaaaccgtgaaaaatggattgaatgagacgaattttcttgctaatttctgagctctagcttcctttggccaattcattgataaacttccttcacctgtgatgtcaatgaaaaagagaaaagtctcaccctttctctccttttttttccctttttctctcaagtggtatacaactttaagatcgttcaagaaaaaaaagaaaaaagaaaaccttagccacctaatcaaattttaaattctatgttttgactgtttcagcaatagctttttacttctttggccgaatgtttccatccaatgaattatgtttcactttaaaaaaatagcttttaacataacacgtacaaactaataattttgattacacataataatattcaaaatattaaaaagctatctctcgatgtttatttcatattgttatcaacatttaaaaaaaaaaatcatctgtataaaatatgcatcagtagttttgtgcttaagcaaagaatacagagggggaacggacacgttattggtggcgtcgtgattcgtgaatgtaaagttaaaatagaagatctgaccaagcaatatcaattaaaagaaacagacaatgaaatccatacctctcattttcttttcttattagatcgcgtaaaaaataatacctttgatttgtgtagcattctggtga

SEQ ID NO: 6602 - DNA, 1159 bp, Glycine max
  Soy_ogl_741 Gm02:49102101..49103259 Cluster 30
actataaatagaaagaatctgatatgctaataatagcttagtaagtctcaaaagatgttaaggtgaaaaattattttatttaaccctcaaagcttgaggtttttataataacagaatccatgcaaagcacaggtaaaacctgttgaacgggatttatgtgttggtaagattaattttgagaaaagaaatcgcgtaatcggtaatactctaatagtgtgacggttggcaatcactaatcactatcaacaagctgtaaaaaaaaatcactatcagctccttcatttttttactatcaacaagctgtataaaaatcactgacaagatgtaaaagaaaaaattaaaaaataaatgcatatgaaacgggaagtcaatccataagaaaatttgtacattattcgactttttttacaatgatagtaagtattttatacaaattatccaaatcctttactattagtttaatgatttaattgatatatgattagtgtaaaaaaattatactattaattaattaaacattactttaaatatgacttttataataattaaaaaaaaacaagttttgattgaagcgggaagtctactcataagaaaatgaacattattggaaaattatgagtataaaattttattggaaatcatgaatagtataaattttttcaaaattaaatatgtttagacttaattaagactaaacttttcaattttttcttcaaaatttcaaaaccaaaatcatactttctatttaatatttttttaatttttacagagcataaagaatattaaataaaatagatgttgaaaatataaaaaaagtgattaaataatagaacctgaaaatgaagagcattacatgtcaatattatgtactgcaacaatttgaggttagttatcttccttggcagttcatgtcaaaagaacataaagaaaaagaaaaaaattactttgagaaaaatatttttttcattgaatctatacaagaaatacatcaccaacaactgcaagaagaaaaaactaacttttacctatgcagcttacaaataagcataataaatctcctaatttatagtttcatattttacagggaacaaaatcccttaaattaagaagaagaaaaaatttcaacacaatataacgtgaagaaaaaatattgaccttt

SEQ ID NO: 6603 - DNA, 1192 bp, Glycine max
  Soy_ogl_7013 Gm20:46285..46219886 Cluster 30
taaatagttatagggtggggaataaaaatgtatttttttatttggtttgataactaactaactaggcatattggccatctctgtactaatgtagagtataaaaacattaaacatatatatatgagagacactaacgttagagtggggacatgagacgcgcccatatatatgcacaaaatttaattgaaaaatgacaatctaaccaaatattttggtgagtcaagctaggagatactctggtgaatctagtcaaaaagataatattaatattgtgttgggagaaattaatagcgtgcttgaaaactcgttaagaatgaaagaattacattcgaaatgtaaaagctatagctattagattatccaaattatgaaaaattatagcccaagcataaaaccaaatacactattaatacattcaagtaaacacaaattacacgcaggtatatgtaatacagagagcgataggatgacttctgttagaataatgttaattacgagaaaaaatatatatacatttaaattataattatacatacatgtctaaaattacaagtttgttggtagtcatatgactaaaaagtcatacatttttttttttttttttactattcaaatatatttagtattttatatttataattttcatttctcacattagtaattgacttgagtttgagtcaaatccccttgatatttctatattcatatgtgagtgtatgtggatgtttctagtaatacttttatttatttatgtgaaaatgaaaagagtacatattaactgtcaagtcttattataaataatttagattaaaacacaattataatataatttttagtttgtatatatatacacacatatttaagttataaaactaaattaaattaagccgtaaattattagtttattttattttaaaattaatattctatttaaatgaaacaaaaccaaattacataatattttaatgtttgattaagatgatttattccttataaaaaaataagataattttgtaaaacacactctaagtagagtaagaagtaatcccgcaatattattaggagtcttcaggggtctaaatctatgattcaatgtgatccaaattatttcacggattgaattttttaaagtgtttgagttaaactcaattcaattcaattaagactcggtcataaatggattgagtaaaag

SEQ ID NO: 6604 - DNA, 1054 bp, Glycine max
  Soy_ogl_406 Gm02:5703901..5704954 Cluster 30
ggttaggttcccccaccttggagtattgattatttggctctggttaattaccacttaattaggaagtggcagacttgcaagtttgtactcgtaatggacgctattggagtgagggggagcgggggaattataaaagcataaagtgaaaaatatctaacaatttgtttaatggataataattttcccaataaagtgtcataatcatgtgttaggcttttgcattattaaaaattaaaaattaaaaattaaaaattaatttgtaataaagtacaatactttttatttaataaccgaaattttataatgacttaagaagcaacgctttcatatttttcttgaattttttatattaatgtatattctttttatttgtcctaacttaattattttaattagatattgctcacaacactttttttttaacaaaacattgttttttttaatgtaagaggattatatcatttcattaatatataataacaatattgatataatcaggaacactataaaaaggatgtgaactttgcctttcaaaaaaaaaaaggatgtggactagcataacattgctgaagaacgagctactagatttgacttgcaaaacattgctaacaacacttttactataatatttaataacaaacggattttaataacttcattacctataaacaagttttcaaataaagtttaactaaaattacgagtaaagatctatcatataaatattcttcataacaatatgcattctacagttttgtcataagcacacttatcataaattattgaggtgtaatgtcctttcatttcgtcatgagcacatttataatgaattatcgagctgtaatattctcagttgataaaaaaaaaaaaggttttagaagacatttatttcacgaaatattttagtacttttagaaatacgaaagtgagaattcttaattccaagcctcataatcgcaaaacatagctagctaccactaattgcagtcacaaagtcattttttttcatactcatcaaccttttttgccatttattattttctcctcacaatag

SEQ ID NO: 6605 - DNA, 1119 bp, Glycine max
  Soy_ogl_5211 Gm16:641482..642600 Cluster 30
ttccctttgactggatatggattcagactagcctatctatctatatgcacttcaaccttacatgtgtaattttatttgtttagcatcatcatgtattttgtatcaacttctttctgaggaaaatgactcctcttcccaacacaactcccattgctcatgattatccctataactccttagtgaatgtttggttcaacctcacaaacaaaaaacatgaatccataacgtgaaaatctgaagctatatagactagcttttatattaacatgaaatttcaaatggattttgtcagacttgatatcaaaccaaccatgctattaatattagctcatggtggttttttttcagagctacctgaaatttatgtgataaagcttggatctttcttacaatagtaaacctaatatatcatttgcatactaatattttataatttaaatagcaaagtaaaattgtttttaaaatataaatataattatattttgataacattattttaaactgtgttttataaccacaattgaacttgtaacatcaattttctttatgatctacttaattgcatcacaattacattagctgttagggatataagtgggtcagatttgatctattttgcaacccaacctaataaaataaaattgggttggattgagtcacttttatttttttgtaaacaacccaaatcgaatcaagtgattaaggttgagttaaatagttggatcgaccaattaaaatatcaaaatattctggaaattaaaaaaatatgaaaatctaaaaaaacaaacaaataatataacaggaaagatgaaataaaaatacatttcatcattcatagttaaaactaaaaagaaattaaaattaaaatgagactagcactatattaattatagtaatttcataacttgtatttagaacccaacaagtacatgtagtattttatcacaattaaaaattaagtactgaatcagttcaagacatttgaagtaaaggcattcgactattgtgaaaactagttaaacatgtacaatctgaccacaatcaaaatgacaatgtacactttataagaagtttagaatgaactacaaatagaccgcttcaactcaagcataatgataa

SEQ ID NO: 6606 - DNA, 1098 bp, Glycine max
  Soy_ogl_6194 Gm18:55968701..55969798 Cluster 30
tttcagtaggaaagtttttctatataatgcttttaatttgttcttatcatcggatggatataaaattttcggatagtgggataatatatatcagtatgacagaaataaaatcattaagaaaacacaattacgtgattcagagtagaatattgtggcaatgcttgatacgtacttactgagaaaaggctcggtatgttgtttataattgttttgacttgctttaatgattttaacatattgcatgattttatacttttcagaactagaaatgtatccatacctgcttaagcaatcatttctcctatttattgcaaatccacttttaataatatttatggcagaaagttctttcatgtctttaaaacaaatggatccggaggtcctctgcagcaacaacaataactgcacattgaaatattataccaaatactagtatatctctaaagccattcattgacaaataaaaaataaataaacaaagtcatacatttaaatattatagagaattcaaagagaaagtcatgttcttgtcataaattatcattatgtgctggataggtcctttaataagtaatgttgaaatgggagccaatcgaatatgcaaaaagttcgtatcctttaacagcatctaaaatagataattagatagataagtggttaattatcttaattgtgcgggtattataattttatatgaatttaaatattttatataaaaatttattttaatactaagattgttaaagtaaatatttaaattaattttacgagtctaatattacatgaaaaatgttatttatgttataaatgttttaagtaattttgtgtaatctattttaatgaaaaaaaattaagtaatattacttaaagttaaagttgaacaacttatataaaagtacttctgttagagatactctgatagaagcaaccaggcatacacaatgttttagataaattacagtaaaaaaagttaagtctctttcaatttatttaaacaaaatgtccagcaaaactaaaaaatggatttttttttttccgctagcaatgattttttaagcatcgtttttaatttgagttctgtgagactgcaatattcat

SEQ ID NO: 6607 - DNA, 1503 bp, Glycine max
  Soy_ogl_739 Gm02:48983801..48985303 Cluster 30
actgagagactttatctattttggatgtaagcatattcaaatatctatgctctatattaggttgtggacatatgagtggaatgtgggcctcgccgtggagtgttgtgttctgggccttttttcttccaaatactgtgactgtttttttatgcattaaaatactatgactgtgtacatttttacacggttaagctatcataaatcatcttaaataaaaatatatgattaaataatggtagtgtaatctttttttattttcaatacattttaattaaaaattgggataaaattgtgataaagattagagtgtatagtaagggagtgtaactgagtagtagatttaaaagatacatgagtgattgtaatttgtaaatattataaggataatgttaaatatttacacggttaaccaatcattaaaagaattctaatttcaattcttttagattaatgttaaataatatgtattattgttatttcacttatctataaggataatttaatcttattatttgctgtttttatattttttttgtctcttttgtaatttagactttacacatatatttaatagaactgaaacctcttcatctccctttgcactcattaccaatattattctgaaagtacttgttagcattcttaataaataaactaaaatgtgaactgtctacagctagcaagccaatctcattgataatgagaattttactttatcaattcactggaataactaatgtgatattttcctaggtacatattcggataatctaattgtagaacttgtattatacactattctttgcattaattttatgccacattgataaatgaagattgcgtaatttgaaaccatcttgccgagaccgaaaacaaacgtacgttttgtaacaaaaaagactacgtaattatatccttcggttttctgaatgaacctgttatcctcatgtaaaacctgtcccatttcaaagtcaagttatgccacaagatcacacacccttttgacaatggcatcattggttgacgaggtcgaaaaaagttaaccgtaaatagagatagagaaaataatagatataataaattatactgtatgataaacaaataaaaattagataaaaaaaaagattaaatacatattcataataatccagtgaacccaccctcgacgtcactataccaattttatttggagggaaaagttttattgtctcttctacaatcttcttaacgtcacgtatttcaaggggtaggtatttttggtaattgaatagaaaattactcctatttcaaaggggaaactaattggtcaagtgctgattaggtaattaaaacgaatatctttaaaaacagaaagcaaatcagtttatttatgcaaaactctacagtcctctaaacataacagacaaaaaactaaatagtgttccatttgctgtggtgttatgtccatgatttgtaaagttgatgagcatatctattttcctatttataataagttgctttttg

SEQ ID NO: 6608 - DNA, 1100 bp, Glycine max
  Soy_ogl_1088 Gm03:44718901..44720000 Cluster 30
tgggcctagaaaaacaagtcttttgagattgaataaattgggcttattatagaggggaaagttaccatctacataaagaataacccaacaagacaacttggagagttatttattctcgggcatttcaaatactcgttttaggtaagttcaccccaattgtttttttttttcttaatttttttaaatagaaggaattgaacggtaatttttctcttcttttcttttttcttaaccactcaacccaattcactccaattgtttccaaaatatttttttttacaaaaatattcttgacaaacacatttatgctgtaatcactatgcaatataaacttgttttcattgggttagggtattgaattcatcataaacagaaataaatttctattgtctattgtgatttgtgacatacagtgaaaacacgtttctttttccatttggcatctagttagcattttttttttgtcgaagcaaaataaagttagtaaaaaagatagacaactgtttaactttcaaccttgtggtgttgaaccagaacccgacgctaatgtcgaatttgcatccgctttcaccgtttaaaggcccacgctaatacgctatttgttttagtgtacaattaatcaccattatgtaataccaactagtccaattgaattagtcaatgtcaacaatcaattaaattcacacaatatagacaattatattcaagaaacaaatcaattttattaaaagcaaataattaacaaaaaagaaaacaagaaattaaaaatttgaagaaaactgcacaatgaatctactgtggttcactacatttttattcctgctacgtgataaggaatcttttattgaagaaaactaacaaaacactaaaagttttcccttgctttgctttaacggggccatgtagcagccacaactcataaataatattacaaaataaataatattttctatcaaaatataattaatattttttattttaaaaataggtaaaaacaaaagtcatatcaggtatgaaaattattttcaaaataaaaggttcggatgaaaaacaattacaaaataaatagaaaaagtaaatataaaagtgtttgaacaatt

SEQ ID NO: 6609 - DNA, 1043 bp, Glycine max
  Soy_ogl_1690 Gm05:37090802..37091844 Cluster 30
aatttaatttatttatttaaacgagcctagctaatcaaaactttgagtttaatttgttaaaaaaataaaataaaatttgagcttgtcttgttaaaaaaaaaaagttaaacttatctaaataatctatgacttaggtatatattttttcttttataatttttttcttaaattattttgataggcttaagcttggtcggattcatgattacaaaatttgagtttgatatttatttgtgatcgagcaaattttataaattactttaacttatttgaggatctcgtctaattaaaaacttacttaagtgacttattttatacaaagtaataatattttaacactaatttattttatacatcctatcaatagtttttatctctcttattatcatatcttatcatctattatatctatattttttttctttttaggtgtcaagtaggttttgggtgtaaaaaaataattttcacttatttttatttgtctaagaaggcatgcatgatcaaagttctctaaaaagcatcatgtcataaaataatatactttaaccttacacacttgcatgcataaggtagaatgttatagcgaacaaattcttgcattcagaagcattgaatctaagaggagaaaatccgacgacagccggttggattgagacgtgcacgccattattccgcggaacacgaaacaaaaagaaaggataataatacctaaataaccgacaaaatgaattaattcttttactgatttaaatgttaatgttaccagattaaaagtttttttttaaaaaaaataccaaattagtctctcataaatacaaagtactaaatttcttaaagaaaaacaaagtaataactaaatatattcttttatattacgaccatagtcctttagaagacgtacgggatataatgacattttcaatgttttaaaaaaaaaaattgggggcgggaaaacttagaggctaaatgataaaattgtaaaccttgaatgaccaatttagatttattccaaaaattgaaaagcttgatcaagagtgctcatg

SEQ ID NO: 6610 - DNA, 1059 bp, Glycine max
  Soy_ogl_53 Gm01:2443642..2444700 Cluster 30
tcaatatcaaggatggaattgagaataacatagttaagctaaatatttttattattatacttaaaatattttaagggattaaattattttgtaggaaaacaataaatatttagattttctattaacattgacataaagaataatagaatatgttctggttgctcgataaaaagcatatgcgtgggactatgtgaaacaacatttttctttcgcgaaaacaaaaaatcttaagtaagtacaattaatatatttaaagaggaggaagcaagttgtcgctttggccgagtggttaaggcgtgtgcctgctaagtacatggggtttccccgcgagagttcgaatctctcaggcgacgacactctttttttttcttcttttttggattttgcaatttaaattttggaagaaatttccaaagtagggcccacaatggttagttgcgaactggggaaggtcgagtttcgtctttccctcttgccggccccggacaccacctctgacctaaatccttctattttttctttttcatttcatgaatcattcataccatgcaataattgcttttaaatagttagttgaatagcattttcctattcaatttgatatgaatattttattttaaaaaattcttataatcactaatgtgtatatattccaattatttttttacacaatattcttattctttgagacaaactactggttgcaactgcggctgtattgtagtcatcatctgaaccaatccttcccagcatctagggcacatggaaggtcacaaggcatgtataaggaggaactttttgctaagtttaattttgatatattgttgaaaataaaatttctatactattaataattaattaaataacatgttaaatataatagaaatcaatagcttagaagaatacaatagttcataaataattgacactaaaaacactttattctaagtgtatgtaacgtacgttgattaaatccatttttggttcacatttgaagagggcaaattggcatagtcaagaatctagaatggcatttggttctcttcaatggacgccttt

SEQ ID NO: 6611 - DNA, 1078 bp, Glycine max
  Soy_ogl_1842 Gm06:8043023..8044100 Cluster 30
tcacttacatgttacttggagattggggattggtttttatttttatttttttatctatactatatcaaagtatttaacccaatcacatgttcaaagattaattggaaattgatttgaatcttattcttttataaaagatgtattttttttataagttgttattataattttttattattatttacgaaagcagctatgaaatgaatgtcacattataaattgattatatgaaaaatgaatgattggtgagaattgagtattaatgcactattgatattgtacaatttttttctttctttcttttgactgtcacactagttgattttatttgattattttggcattaatgtggttggaagatcgtcatgcgaagatatatgctgttcctttgatttggacgtaagcctaacggatacgctaccactcaattgttggtcaatacttcaataagaatcagtttagtttagaattgcactgggattttacgtgcatatgtaaatagtaaattttcccttctatttcctacagtaggatttcgaactattatttaatttctagacagtctttgtctcgggttatagtttggtacttgtttatcgagtattgatgggagacacctcgtaaacacttctgcaattgagaaaatatcctaacaattttcttggtggtgggagatactttcgtttttttttttcactgtagaacttctccatgcctagacattagcaatcatattatgtggctgttgattcaactaaaaagttatatgaattactgtcagatgcaattgggatctattatgacacaaagcaataacacaaatttaaaagaggtttagctaaagatgaactatagaaaataatttataattgaatatttttaatctgtgcaaaaataaggtattgtgatgacacagtaagtttttatgtcacattaacaggatgctgtctagcttattttagtattaaaaagtatactttataaaaaatagttaggactctaggtgcaatataaattaataatatctataatggtattttttttgtcaaattataagtcaatgatgacataaacatca

SEQ ID NO: 6612 - DNA, 1000 bp, Glycine max
  Soy_ogl_3930 Gm11:36818701..36819700 Cluster 30
tacgtaaataaatccttcctctcaaaaaaaaattaataatcctaactcacagactaacatccttaaccgtctttaactaaaatttgcgtttcctttaaacaggtggtaattctgtaagttacgcaagttcagatactagtgtaagtgtatctctactcttttctgatttcgtttgaatgttttttactatgttatatatctcactcaaagaacatgtcttgctatctttaatagagtcttccttttccattctattttttttttcatttttagcatttgaactcaaaaccttgcttcaataatctaagttcagttacccctgtatctatgtaatgttggttgatttcattttaatgtttgagtcctaaaagataaatgcttttttttttttggaaatggtttttgtataagattataaaatacacgaatacttcaattttttttgaatcaatatttgttttaaaaaacatgtgtaagcaccgattgcttatccttattgcggggcatggtgatagctttatttgtttaaaacaactagcgtcgcatcacatcatttttaacgtgaaagagtaaaatttattttaacgtcatacagacgtgttttaaccgatagttgttgcattatgtatttgttttaacgttaagaatttaataatgtagtcattgcaccatttttttaacattacaaaataacctatttttaacgttaaactactcatttgaggaggttttcagaaagcaccatatattcatgtaagcatcggtttcttatcccttattgtgggtcagtgtaagatttatttgtttaaaagaactggttgttgcacggcaacatttttaatgtgaaagttaaaaaattatttttaacatgatacacattttctaacggatggtcgtttcaccatttattttatttaatgttatgatttttttaacttgtagccattgcattattttatttttttttggaaaaaatgttaattatattaaacccaaaatg

SEQ ID NO: 6613 - DNA, 1216 bp, Glycine max
  Soy_ogl_4942 Gm15:9273885..9275100 Cluster 30
agagtgaggacaccaaagtccgaaccttaaattttttcaattcacatatttgtttaattccctgtaatatagttggacttaggcgataagaggggcgattctgttatgcttttcatcaatgaaatttaatttaacagtacaagatgatactgctctaattcatacgttctcccttccttttcttgtttggtgtaaaaatattatctttttaatttgatggaaagttgatttattgacgatagaaatgaatcaagttcccgtgaagttggtttggtaccccctccccttaccttgcttccaacatttaaacaccgccacagtaatcgactcgagtagaaatactaatactaattactgtgatgtttgatcagcacttgtgttgaccttaaaaattgaaaagtgggacccccactgttgatgataaactgccaggtggctgaagatggtggtttctggaagaaggaatcattttttgacgacctcaaaatttgtggcaaatcaagtgaacagtaacaatggatttgtcttatacgtgacgctcccacgcacatctctctctcaagtctgaagtacccctcatctcatctcagcaatcgtaacgctgacgagagtcagagctcattcattggctgacagctcgccaagcttcataagccatatactacttcaattttctttttctttttttacttttatgtcacttattatagttgtaccttcaaattttttcatgtcaactagtcttattacttcaaatttattcatgcttacccactcgaggttgaaggattgagtatcttactgattgaatgtcgattgatattattgctttaagttttttcgtacttattcgctcgagatggaagaactataaatctttctaaatgaatgtcaaataatcttattactttaaatctttttatgcttaggtactgaagatcgagggattgtttatctctttagttgaatggaaatcgttccaccaatttatcacttaactcttgacggtcaatttcctgttaggttacttacaactttttttatcttgagagttgtagtgattattgaaaagtaatttgaatgaatgtgtttcattgatatgcgatgtgtaatatatcaaaatatataaaaatggttgtactaaaattggacaacaacctactctaagtaacaattatttaaaatataaattgaagacaacatcaagtagatacca

SEQ ID NO: 6614 - DNA, 1200 bp, Glycine max
  Soy_ogl_3475 Gm10:40557301..40558500 Cluster 30
gtacttaaagtaagtctcctaacaagtgaaaagcagtaaaataacaattgcatgcagttaatttgacaagttataatcagttctgccattaattatgggaaatgtctatccagttggattatttgcttaaggcagattttatttttggcgcatattattacataggagtatcctcagcccttcatcaacaattttaaatctctaccaaaagatctgctagcattgttgcccccttctaacaagaatttttcatatttatgaatcaggattcgaacctaattattatgcttaagatatcaaagcctagcctagtgccactttcatcaaccacttgttagttttgcttaaaacagataaaaaaggaggattgggagatgatgaattattaaccgagttaattataattgttagttgagaatagtatgatatcatgtcattgtttcgtactatatgaaattgatacttgatttctttgaaaccaaatagctagttagaccaaaaacaaaaaccatacaattgagatatcctcgattggaattcagtatgagccccagaatcgtgacatttctttccctgtgacgtatttggcaaacacaaacttcaggcataatcaatctctgaattttttttctcattttggagacttaaatagtaacaataacattagtttagagaccaaaatgagaaaaacatgttactttctgggacttaaataaaaccttaaaaacattgaagacttatttaagtttttctttgtttctaagactaaaatagtgagttacaaattcaaatattagactaaattgaccatttattttccatacaaaaaatgcttcagtctaatgacccaactttcagtaatttttttgggaaaattagcaaaataatttcattgaaaatattatttaggtttttttaagagagaaaaaactccaataattttgcaagacatggtacgttttccaataaaaaattgatataacaatttcctcatacattaaatggaaaatacgtttagtcgaaactttccactccaaaccaaaaaaaaagaagcaactttccttgaaacaaactcaacctactatacatccaaattagctgaagtagttacgaacaaaataacaaaataataaaataaagctaactcccttgtctgcctatttaaaagcaaaacatgtcatgtctaaataattaagcatt

SEQ ID NO: 6615 - DNA, 1200 bp, Glycine max
  Soy_ogl_4925 Gm15:8808301..8809500 Cluster 30
caactcaaataaattgttaatcctgtttgaaacctgctccctctactcaattcatttgatttaataattcaatgcaaaaacataaacatcggctactgaaactgaccaccaataactaactacattagtatctgaagtgtagagtgtcactgccaaaaccttggacccacttctttttaattttggatactttcatcaatatgttattcataattctgagtagccaatagtgtagttgatagaaaattaaatcccaaaggttatttctgatgcagagaaagatgccaaatagttgctgtaattaactcttgaaatcatttctggtagatagccaacatggtcatgagtctcatgacctgagtatatttccatcctttttatttcctgttaagttacatttttccaaactttaatttctaaccaatttccaaagttgtacaagttttgcatatgtccatctttcagaatttttttttgcttagcccttttctgtaaggggagcttcaaacagataagtaccaagcaataagcattgacttttgaaatactactactggttttgcttcactactgtgaactcatgtatgcttctggataaggggctgatccttctgaaaatgtaggcacttgcgaagacctgaaagcaggttcttccttcttgttgaactcagtgaagtcactgtttggatcacttgctgattcgaatggtctaaaccaaaacattgttcattgattgatgaatggagccaatagcactaggaaaattttaaaaccctgaacattactaaagtagcaactttgagaagttagtcaccaaaaatatgtaatgtatcgtcccagattgttataggatatatgtttaattttaagtcataattgcatcttgaattgcagcaaaacgtgacgtgagatatttttctagagaggatatctttctagagaggaatgatagttctttacattttctaactactggtggttactttttatttttcatttgttgtctaaaagcaaggtgtggtaaaacgagaaaacatcctccatactactggactggtacctagtgtaactttagtagagtttgtccgctaaaaaaaaggttttggtgatatactccaaagaaagaggatgagagttaactccacattcttaattattcttgtcaaccatgttgagatttaaatgcttaattaaaacata

SEQ ID NO: 6616 - DNA, 1253 bp, Glycine max
  Soy_ogl_1010 Gm03:41201401..41202653 Cluster 30
aaatagagaaaccagatatagaatatctgaatattgtaatcaaccgcacatgatcatatgatgaagaattctagcggaacgaaattagaaagagaataaattaaaatgaatccacaaaaccacatggggtcaatgattatcaagtaatatcttggcttggtggtcatttagttatatcatcaattatgagtgtgactgcgaggtaagatgtcttatcactcttgtaatcctcaagtctaatattcttaatcaagttcatcttcagtatcgatcgaactcatcgaagacaattctaattaactccggtgcatactatatacaaatacattgttctcacaacgtgatagaaagtattcttctcaacttttgaaaataaaatggatggttatgaattaatcatcaagattttcaacaaaatactcgttaaagatttaataataattcttttttattaaaaatctcatgtaacatgtatgatgcataaaaattatggtgaaataaaagcattaatgattttttatttttaattctttaatcatgcacttacaattaatcacacacacatacgtgataatcacatgttccttatctaggacgctgatggggaacaacaccagggtatagctaactgaactttataatgtaacgtcgtcgtcttggtgaccaaacaatacgagcatattcccagacatgtttcgtgccactctaacttaaaatttatattcccagacatgtttcgtgccactctaacttaaaatttacatcactgtagacacgtacgtacctatgctcgtacttaatatagtacaaaaataatttacaacagtggaactaacaccaagcaatttgtgcgcgacatggacaacatattgttgacttcaatgagtgtggaggtgctctatagccaaatgagtttatcatcataacaaggatatataggcagccttggtaatgctccatctgaaagaaattctttacgtacacttaattatacagttacactgtccacattttttttatattgtatatagatttagataataaattttattcagatatattttttaacaaataatgttttatgttttaactattaattgttacaaagaattttgattattttcgtttcaacttttgtaaataatttatgacttttgtggcatgaaaatctactaattaattttttatgttttggcacgtataaattgctagttgaacaggtgaacttgtgcactaagacttatatatctact

SEQ ID NO: 6617 - DNA, 1383 bp, Glycine max
  Soy_ogl_2479 Gm08:3022901..3024283 Cluster 30
tcctttattcccgtggaggaggactatgatgattttttttctaataatgatattaatataaaatagtccttagcaaagtaataactaatttttattatatattattaatttgttgtatatataaattaatctgtcaggcttaataaaaaaaattaacctaaagtctgatctttttaattaaaaaaacctttttaaaaaatcttaacttttataataaacaaaccttttgtaagttaaactgtgtaggctcctgacgaactatttgacttattttcatctttaattacaaaggagatcacgtagccggccaagtagaagacgaaaaaaagtagttcctgagaaaatcatttgagagtacttcggaacattcaaaagttggtaaaaacacataggctcgatcaaaattacctttaaaaaaaatatttgtcatctataaaaaaagttgtaagcagggtactacataggctcagaaactcaaaaggaaaagaaatggcaacattatcttaaacgtttgcattatctatattcctctataagttatgtagaagtgacaaataatgatttggtgaagtgatagctcaagagaagatcaagcttgggtgtgggtgccagaggaatgaagggggcgttattaaatgtaatgagtacttgattagtaggccacaccgcacacttctactggacctggcctggattatatatactatcagaaaaaagaagaaaaaaaaaaacttgatgctgatgttctttctgcaggtttgagatttgggattttagagtggtcatcactcacaggtgcatattcgatcgtcttcatacacgaccattcttatgtgttcatgcaccaacacaattcggtcgtaatagaacacaccaacagtatatcttaaaaaccctaaccaacactctacgttaataactatatttatcattttcgataatagtcaagtcagttgagctgttgaggtatatctctttgtagcatgcaataacttctactaggcagggaccctctctttcttattcagtaatttaatcttctctgtacataaatatccgggttaagttgcacgaattgttttttataagcaatttttttattttatatctatagccacattttttaatttattttataaatattaattcacagtacatatttaaattagcttatttaacaaattataactaaagtattttttttttatagaaacatccacttattcaataagctgatagacgatactcatcattgaattcaacgtttaagtaaatccatgtgcactggactccaattttcaaccttggcatctcaatcatttaataaatcaaatccatcaaagtaagtgttggcacagggccaggttgaatcaaattgtggta

SEQ ID NO: 6618 - DNA, 1066 bp, Glycine max
  Soy_ogl_5861 Gm18:1298901..1299966 Cluster 30
actactacgtcattattggggttgtttcttcctgcactctcacaattatttcatgcacttcctgtcattgcattatgaaaaatacattctggaatgtaaattatatttcgaaataggttttctataatacaggggaaaatgcaacaggtaataatgaaactgcagaaagttttaccctatgttattattagggttgttgcacttccattattgtttcatgcacttctcattacattatgaaaaatgcattctgaaatgcaaattatattccaaaataggttttctgtaatgcagtggaaagtactggaagtaataacgagagagtgcagaaagttttaccctactattttggagtgctttattttccgaacgtacaccgtgtacacacaatccgattaatattgtttatatttatttcatcagtgacagtaagtaatattcaggaaaataaagcagagatgaagggtagtgagattttgaggcttaccgaagaagcatagggagagcagaaagaggagaagcgttttggttgccatcagagtcatgaatacgttgataggtcttcttcataaacagagtgctatgcttgatagggagtgatgaattcgccatctttatgtttatgacagataataattactactttcccataatgctggatagggagtgatgaattcgggagcatatgctggtcatcgccaaaatgttccatttatatataccatcatcagcaaattatactgaaaagagacacgcgtagtctttttagaaattcacataatatctctctctgtttctttaatctagaaatatcatataaattttgcaaaacttataaaatttcatacaaccataaaagtgtgtatattacttttatatattgaatataaaagaaagaaaaaagagattgcaaattacaaattagtacggaggctagacataatatgtatgaaaaataaaataaaagtattccatctaaattagggctgccgacttccgtcgttggggactgagcagtagctgacaacaaatgcatccacattccaaatttcaaaattcatttccg

SEQ ID NO: 6619 - DNA, 1000 bp, Glycine max
  Soy_ogl_6232 Gm18:57638901..57639900 Cluster 30
gagtactcttcttcattgaaagggctcatgtggccatggctttgaatattgaagaaatcatcaccacccatttcctataatcaacaaatgaataataaaataaaatgttaatcataagagaaagagtagtaatactaagtagcaatgtgtgttcaattagttcctagcgtgttaagttagtttcatgttttggatgtgattttcataagctaataatcatagtttttacatttcaaacgtgattctttctctcttaatgaatttcccaacatgctatatatattcatagagctagctatatatcatgtaagaagtttgaagaacaataataatgatgagtggtcgatctttacccagttagaaacaagtccacccatgatcctcattattagcacaggtactggctttgagcacgaccaaggaagttggtgaatatgctaagcacatgtggatcggagtgcatttaataaccgcttaatgtacaaaagaaataaaatgaaaaaaaaagtttggaatttgaaatgaaataaataaattaaacgagggaaagatttaattttttcttaaattaaaaaaaatattgttttttctcctttttctttttttattgtccaactcatgcagattaatgctcagtttggatttatggaagggacaatataattgtggatataatgaaaacatggcagcatttaattagcttatgtgttcgtaaaaacacaaattaaaggaaggaaacaaatcagtaggtctcacataaaaattgtcttttaatttcctcctctcatttgtccagataagggaagggttgaaagtagcgtcaacatgcaaattaagacaaaagaacaatactgctagaacctacaaaatttatttcctcaaatctatacgaaatatttattctgtaaaaagatattatgattttttttttttgttttaaaaaatgatagtcattcatttattattcatgtgacgtgcccgtgtgacgtgtccgtgtgac

SEQ ID NO: 6620 - DNA, 1468 bp, Glycine max
  Soy_ogl_3362 Gm10:4189801..4191268 Cluster 30
attttatttttgagtcaaaaataattctgtgtattaaataaatcatttcttatatataaacacaacaactttctacaataagatgttaattctaatgataatatataattacttatgttgtaccttagtaacctattttctcatattataaaataaaagaatgattaacttagatcaagagtaattctttttgagagactcttcatactcttcattcatttaaatatacaccaaaaggagttaatgaataatgaaaataaaaaataatttgaaaaaaattacttttataatatatattcccaatatactcccaatattgatatgctagtggcctaaagaagtataatggggtaacaatctcatatgaatttggtgagattggaacaatactgtgaatttggtgagattggaacaatatgttggcgccttgagattctatctccttacttcaagctggcattagctgcaactttgtgtcaaggtttgctaatgaagcttctattgtggttggttatgtttatgaggaggttctgtagtatctctggttggaatgaagagctaatgaaatgaaagttataataagaaagaatagccaataccatatatacaataaagttaacatttgttaacctttggggctttgcctttatttggttgggcactaatggtgggtaagaggctttctacatgaagctagtggcatagtgggttcattataaatcacagtatgtgtatgttgcccataatcttttaattatattaagtaaaggccacatcttccattggagtgactttggtagatgtttgaccctgtgaggtatcaatcaatcatcactcttcacaatggagaggagttgttcatacaactgtcaaggctagcacatgtgcatgctgaattttgctaaagcagaagtttatttcaaattttgttaccttgccccatattttcgtgtagacttttatgcaatttatccactgaatattgtacaaaaacaggcaaaaattaataagcagaacattttccttgaaaccattttttcttgaatcaaaggcacccacagaagtatgtttcttatccaatcttctttctttcttgcagtttctgtagggacacaattaagtctatttatggtcccaattcaaaggagcttcataatttcaatagctcaataaggaactcctctagttagatttcttaattgctcaaggtttttttcttgtccttaccttgattagttattatgctggtgggaacttctgaaatatgatttcttatctaatgctagtgctgcttgaatctacaaagtagaactagaacctagcaacactgggaaaaaatagctatggactagagggttattattgtatgctgtttttttggaattattgattctttattgccatatatcttattttgggctaactgaaggaccctaattagtaaaaccaactatttagtaactgataa

SEQ ID NO: 6621 - DNA, 1266 bp, Glycine max
  Soy_ogl_4491 Gm13:36663101..36664366 Cluster 30
tccatgaagattttcaccttcaacaatcaacattgatacatgctttaacatagtcccactccatgagcattcaaagatgacgtacaattgatcatctgaaggaaatgtgacttatggaaaatgcataagtgttgatgtttgcttacctttataagatttgaaagatcttgcatttataaggattcactcattaatctattatgtaaattcattcatattaattatcacgaaaacctccaacattaggttcaaagtctattgagcacctccaacttacgtatctatccatatggaatgtcaactggcattatgtatgaatacaaatacaatttttaacttgcacgtcaatacacagtcgattatatacatattcaccaaaatcatcaacataaattcaccttactcgtcgctagaattccatccaatggtttactaaaccaagtaggaaaccctcacgtaccatagattgtccaccatcaccttaacaaacatcaccacattaagataaaacttcattttcaattaataccataatcattccaaaaatttagcttaataacaataaaatatttatctcataaaaaaatgtaaatatggctcctagcattaacacatagctttaaaccccattttggaggcttcacgcttagcgtatgggttttcatgcttagcctacaaccccaggaacaaaaaaccccattctagaggccttaggttatgcctcattgagtctcacacttagcttgatgcccctggaactaaaaatgagtcatggaggccttagtctaagcctcaaaattcctaggtttagtctagcattatagatttgcaacttcatgaatttttgtgagtttgcttcctgtggccatccatggtcttccaaatgcaaactaagcgtggcataacattccttaacattcatattacatttctaactgactaatctattaaataaaaccctcattcaagcttaatcttaaaaattctttattttccaacttacgaggtttcaaaatgggaaaaaaggaaaacaacccaataacaatccaatgaatcaagaattcaatatctcaacacagtatagtataagataaagctccccttaccctaaaacggtgagaactccttaagagggagattaaagatataaactttgtgctacaagaaaggtccttaccaactcctattgtaggttcaactagaagaacacaatacaataggcacctaaggaagctctagactggaagaaggaccatccaattgtgt

SEQ ID NO: 6622 - DNA, 1061 bp, Glycine max
  Soy_ogl_5288 Gm16:4312501..4313561 Cluster 30
ggatagttgaagcaatcggaattatattattaattaatatatttaaagattgtttgcaagccccacgtcttggcacgatgggctccttgtctaataaaattgtcatattctctgatctcgccctagcattaaagccatgaattattatgtagagtacaatcaaagtcaataacgcacagtagagctttctgaactccataccttgttagtttggacaaccgtcacccaaaagaaattaaacttgataaccatattttagcatgccacattgccatttataccaagttctcaatgaaaatgcacacaagaaacgatactgacaaaacaaacacatatttacttctaggaaaaaaaataagaaaaaaacaaaaataaatttcttcaaaatttaaaattaactcttcattaattaattgttaattaatttatatatattctctcatcttttagagaaattatatgaaattttttacaaatcaactaatatcgagtaaatattatcgagttaattttaacttataaaaaaaatcatctcattttcttcttattatcttaaaaagtgcttataagaaagcatacccaaatagacccatagtggctatacaactgtaattttggctctaaaccaagtacaaaattgctgataaaatccatagtttgtgtttgtttctattaagatgcttcggtgatctgtctgttgaagaaagagaaaaaaatattgtgctcaaactctccctgtatgtagtgccccccatatgcatccccataaatgcaattcacgtgctgtaagggccataactaatgctggatcacaaaagggatatcaatcacatgatttcagcaagaactaaggcagatttagttcatgtgcatttcacaggttgtttgcttatgtcaaagaccgaaaataaatggtaaatctaccttgtgcagtaatatactggaacatcaagcacaaatatcttccatttcatcttataatgacaaactgtccgataccaacttttttttttaagtatagccatgcataacccaatgattagtactcagtttcttttgaa

SEQ ID NO: 6623 - DNA, 1000 bp, Glycine max
  Soy_ogl_1151 Gm04:909601..910600 Cluster 30
gctttcttagatgattttattggctatagctaattgtgtgtcgcacgcacacctatgtatatgacgggatccattgacattgtatgtacgtctaaagactcacatcaaatctaaatcgttaatacaaatcatgatattccaaattaaaaatataaaaatgcttgttgctttgtacaagaaagaaactgtatcttaatgcagaatactgcaaccacatctagatgtacgctattaatttatttcattttgatacattccgaatttagttctatgatgaagggcttctcatcaatttttctcaacaaaaaaattcacaaagcataaggcagagcaattatcagcttcctaccccttgactcccataacattaaaatcctaaatggtgacgaaactgacgacgaaaaaacataaaagcatattactttgtatgtgattttgtgatgacattcttattgtgaaaactttgtttgcttcattgaacattagccctcaagtagtgagctactcatcactcacccttgtagtatctttacaaaaagaaaacctgttttttttttttttatttgaaagttgttcaacttgctggatggaattggtggttattgttgactggttattgaacacatttgtaaaccatccatgactaatcctaagaaattccaaaaatatgccaaaattgagaatgttgaaccgagagaatttcatttcgaccaaccctgcgcgagaactatttcaaaccaagcctgcctaggagcaatctgtttgagtgtttgatatcaattaatcgtatatggatggtacattggtgtgagactttgctttgtctgcaattttagtttgccctacattataactcgcttgttaatttaatgataacgattaataaatgttaccaattaagtgtctgcagaaggatgtgtatattggtagacttcttcaaaaattgtgtgaatagaccaaagttgttgctttgctcattgttctgatattgattcacaaa

SEQ ID NO: 6624 - DNA, 1000 bp, Glycine max
  Soy_ogl_2912 Gm09:629001..630000 Cluster 30
ttggatgttgttcatatgagacttcaacgtcaagatctttgttcctgacaaaattagagcctgcaacatccacgaattctgtaggttgaggccttgtttaccttcctccttctgtatagaccttttacctaatgttataattgttgtaaaacctgtaaagaataactatttccaaagaaaaataattgcataggcatgtattagcaaaatcaaaatgttgcaaacaaacgaagaaagttaaatcgaagcacaaacatgcatgcatgcctgaataaatcgtttagcatgaaggttagataatctgcatatacgcacacatttaaagtctgaaagatgaaatatagagtctgatatgtacattctcatgtacaaaaacagagttcactccactccaatattgggtggccatttcagtcacattggtacaagcaagaatgcttatcatctcagcaatttccttggtttcatatctacatcatgatgcggagcagcattaattcaccaaaacaaagcaccctaatgaggcataggaatccagcaggtgccaaaaaatgcagccaaaatttggcactcatatttacacaagaagtctcattcttatgtccacaatctttctactactctttcctttaaaaaaattaaccataatcacaaccattaatttcctaatttgtagttaatattgcactttatcatatgaagtactgcaccctcctttagaagagccaaatcccctttcaaaggcactccagaatagatgcaaattatctttgtcacatctggtttgccaatcacatccaatgctttcttttgtcaattccttttgttaataccaaaatcaatcaagaataaaattagggtgctttgtttttgctaatcaagaataaaatttcctacttgtctttatcatggcatggtgatgcatttcaattcgcatcacatcagtcttcaaggtcttcttattcggctcagttttcaagaatcaaacaagaatttgaaa

SEQ ID NO: 6625 - DNA, 1006 bp, Glycine max
  Soy_ogl_3313 Gm10:1986101..1987106 Cluster 30
gtttgaccaatattaatgcacgtccaatgaaaactaacacagatctaaacatatactttgaagtggaacaaatatgagttcacattcatacttttacactgtgtttcattaagtggaaaaggaaataaatttcttaaaaaatccgtggaacccacttcgcgaaggtttcgttctaacatacgaagaaataagaataaagtattaatgaaacttacactttaccaaagtatcctaatactgagcttctgttgctactctccttctttctcttttcttcaacgaatttcgtatcaatttttcaaagagactatgtacaattgttaaaatgcaacgagagttattagtgacatataatatgcttcaaagggaattattagtgacatattattatatgcatctgttaaacatatttttttgttaaagttaaagagaaattacttctggttgaaaggcatataatcaattatgccataggacagcatggattttgtcattttgtgatataacctaaaaaaacatatatttgactaaagttgattctatcccttctcaagctgaatgatgtaatggcgaatataaatatattactggggatgatgatgcattacaagatatattagccacctgcatagatgattaaactaatgttgagatgtgtgattctcttaaagggttacttatgagtcaaaactatatgaaacatcttaaattaaggtcaagtgctccgaaggactttagatgagttagagcctctcaattatgatcacgatgcaaaaatgatgccaattgttgtaaaatattagccaagtacattaccaatcacttgttgtgtcaaggtagtaacttgcgattttgagcattcacttccttaaaattagacttctcttggatcattttgaatcaatactcaataattttttggacaaaaataatgcaagtacatatagaattcttcacttctgtagtgtgtgttaatgaacattttcaaaattaattgtaattaaaa

SEQ ID NO: 6626 - DNA, 1000 bp, Glycine max
  Soy_ogl_3532 Gm10:44876401..44877400 Cluster 30
atttagatgacccctttatcctatagcaggttgtacccatctattgatgtcttggatatttattagcatcagacgtatgggacattgccactatcttgagaaggaaaactgtggaataaattatgaaagacccaacaaatcttctaaactaatcaaatttcattgtttgagctctacattgatttcagttaagcttttttttttttttaatggttgagatcagttttggtatatatatatatatattattgcttaaagtgcacctaccacccacaaaaattttggacttagttaactacttatatgtgctcataataatactataatagtatatattaacgaaagaactatatattctaatgtagatagcttaactaataagtttttggtgtaacatacgcaaagtaattattttgataagcattagctgatgagtgagtttggttaaaagacaaagcagggggaccatatggtctttaatgttgggataggtcaccttctcctagtctatgattgcctttcttaattaggtggtaaatgcagaacaaagctttcggatggggcaccattgaattatgtcatataagttacacgtatggtccctttcgtggagatatatatgtaaacttagaagtatgaaatagactagcattctttcaattttctatattcatgaaatgacgggacattttgtctgcaatatcatgctctgaacttagatttcatgcggctttggttttcatagtgattacgtaaatcagaaattgaagtactcactctttttattttaactacatcataagcgaagagaacacttttataatgctagctagtaaccagggctaggaacgtgaaacgaaacacgcatatacacttattaggccaacggtataattagcaattacaaaagagtttaattttcagtaatcttctaatcctcccatccaagataaatacatgtgaaaaactatcaattccatctaattttcttttttcccat

SEQ ID NO: 6627 - DNA, 1110 bp, Glycine max
  Soy_ogl_3821 Gm11:10195201..10196310 Cluster 30
gtaattattgcattagacttgtgttatagtgtcgatgtgacgactccagacacattcaatggcgctgcctgtgcaagatgagagaatagtccgaaagtgtaaagtaacattaatcatgactttttttcatttaattgctagatattaaggttggtaacgtgacattgttttcaagcaactttggtccattatattagcacacaccaaaaaaagaaaaaaaactcgcaatcatgaaccttcgtcctgtctgaatttgaagccaaatgtaaagacaaaagaaaatgctagatggttttctatttggagtaaggaaatagaagaaaaaatgtaatgaaaaaggatttattatgttaaaaatatataaaaaaaattaatgtttaataaatttaatgttaaaagtatagtacagcatattaaacgtttctgtagcaaaatctaacataaaatagcactgttgttttgtacgaactatacaatataaaagtaacaatgaaaatgtgagagtcaattagacacctaattgccatatataggtgagtgaaaatgcatataaaatgattggttaaaaacttgaacaggacatttttgtgccactttgtacaattcttttctcacaaacaaaaatttcccaatgtaaactacaggaaaaaaaatggtttacataattttattgaccatatatatgacatcacatctacgtatgtgatgaaaatagagagagattctacgtgtgtataaaattatgtaacgcagaagatgtgtagtaggttgatgtaatcatgaaaataatggattcagctgactagtaaactatgtgaatggatttatgtattgctcacaaaaagccataacgtcgcctgagagattcgaactctcgcggggaaaccccatgtacttagcaggcacacgccttaaccactcggccaaagcgactttgttaaaaatatttgcagtgtaactattttataacctatatttctaaatctaaagtctaacttttaaatagttatgaaagtggctttagaaattcaagaattttagagtgcgttttagttgatataaaatttttcgtataagagagaataggaatcatatttttataggtatgtt

SEQ ID NO: 6628 - DNA, 1108 bp, Glycine max
  Soy_ogl_4518 Gm13:37419001..37420108 Cluster 30
tacttcgattactgactattccttcaatcattttctttgagctgaattgaaaacgtccgaatgaagagaacagaattactactatattgcacacatggacgaaacagaacaaagcaactctgcaatgttgaaccaatggcgtgagagcaatgccccataggagaggcaacgggagcaaaataatttatgtcaagagagtaaccaaacactggatatttccattccaagtgcattgtcaccatattttggacaatgaccttttgcatgtgtaggagcctttcaaaaatataagaaaaacaaaaaatagaaaaccttttgcatgtgtaggcaattggaaaaccatggaattttatgcggtttcgtttctcagcggcttcaaccttatatttgagagacaaaatttccccatgcaaggtctattatatatttgtgtggcttcttttgtccatattagtcaattttctattattgctccgggaacaaacaataagggatagagttttctagattgaaagtgattaaatgacaaaaggggggcaacatgtgtactttgatatttgtggtggaaaataggtttatttatgtgcgtcaattcagcgggagttattgtagcctgtgtcggggtgaccaaatgttcacatcagaatgagaatggaatctaagttattagaaaagagtctattattctcctttcgggactgcagaaaaacacacacacaaaaaaatggaagtgtagttggaaaatggaaatccaccctgcataatgaatctttgctagtattttattcttgagagtgagacaatatttagagacaataggacaacaagaataacaacaattctagagggtggggcaatatataactacatttttttatgtactcgtatttattagaaatcataaaaagttatagatctctcttttgtggccaacaaaaaaaaaattaatagactttataataagtttataaaatattaacaattaatacgtatatttaagaatgagccattttttttgtacagcttaaaatgattctatgtttcacgtaattaggacaaaaaatgcatatattattgttttctaatataaaagattggatgaaatact

SEQ ID NO: 6629 - DNA, 1188 bp, Glycine max
  Soy_ogl_5567 Gm17:7545101..7546288 Cluster 30
taagcccaccattatatacatgtaataaaatgatcccccggtgaaagacgtatacatacgtcacaaagcaaatatgttgctggcttgtaataacggatgcaaaagttttaagttctgaaggcaattctcatgtttataaattagtggggcaatacacttattatatttttataactatattttaaattgtgaagataacttataactctatacattcattttatattaagaaaaaataaaaatcttgcggggcaacttccccaaaaccctctaattaaggtaaattcgtccctgttggcctacgcataaataaggaaatcaacccagtccaaatcctaataattaatcgatcgagcatcattccacaaagcagtgctacatgactaacatttaatacacccatgtcactctgataaaaaatcaagttagtcattgattaaaaataaaattaaattaaagtatacaaatgagggataacttttatgatatcgaaattaaagagcatggtgaaagcgtagggtctgcacaagtattatattaattacctgtgcattcacgtaaatgacagtgacaccccataataccgaattcggccaacaatatataagacttatacaatatacgggaaacgtaagtaaggtgcacttatgtcattccattttacttttgttcacctcatggtcattgatttagatgttgtatttgagtccttgcagttgcaggtgatcatatacatggacttgacatgaaggatattttgaagacttcaactgaaatttcagctaatcttgcaaatattccatttctcaagattgggatagaacaattactacaattttgggacactattgtataaaaaaacagatagtacgatatttaaaatagacagaacaatatattataagaagatttttatcaaagtaacattgttttatcaaagaagataataataattgaaaatttctattaaagtataaagatcgaatataaaaagaaaaagaaaaggatccaaatacaacaaattaatgaaaatttaaaaatgttaaaaattaatgaaatgttactcatttatcaaacacgtacttttgtttttaatgaatgtaagaaagatgagcatctaatatctaacagttagatggaaatagttagggagagaaccaatattctagttcgtttcctataaaaata

SEQ ID NO: 6630 - DNA, 1200 bp, Glycine max
  Soy_ogl_5862 Gm18:1300501..1301700 Cluster 30
aatttattaaaaattaaaaaatctaaaataaaaaatggaattaaaccttcataaaaaagcttcgcaatgcccggcattgattctttagaacggccaactcaacatgttgagcatatttttcgagggcctccataaaaattgtaacatgctgattaacaaattaataatacataagaatttattatattgtaaatacataatatttttctcatagtttataactttgtcccaagaagaagtcaataaattgtatttaattctcattctataatcatcacacacaacacaaaaaaaataatctcaaatctataatcaaatcaatataatgtgaagattaataaaattcccgctacgcgacaccctttcttatgacaagaaaatcaaaccaatttggctctttcaagtaaatttgatgattaattaggacagtacatgggtgcatgtatggatcaacatgcgaatgtcgtagtggtgcagttatttcaggggctatgctatccaacgagattgttcatcaaaagggtggacataacttgtggcgggaacgtgactcatctttggtggtgcaatcttttaaaaactcggatttagtcccatggaagctgaagaacagatggtctaattgtataaatttaaccaagactatgaattttttggttggtcatattttcagggaggataatacttgtgcagacattcttgccaacgaagctcactcttataatgagttttattggtggaattctctccctcagttcttagctgttgatttcaataggaatagatatggttacacaaacgacaggttcaactaatttgtcttccatgggcttgatttatgtcctcccatgccttttgttgatcccttttttggtttaatgatatttatgggcttgtcgtttgcagaattccatgaacggtaccaacctagttaggatctcttatgcaattcttttacatcgaccagcctcttttgactaaaagaaaaattttaagaataagtggttcaggttatatcagtcacgtccaggaaaccataactcgcatgatgtttatgaattttttataatgaagattagatttggcccttgtgcatagacaaaaactggggcctagctcgtttaagcaatgcaatattaatcaggcattagttatttccactccctcttattactaatacactctattttatttattttt

SEQ ID NO: 6631 - DNA, 1151 bp, Glycine max
  Soy_ogl_2188 Gm07:4547450..4548600 Cluster 30
cttacatgtgtgcgcgcgttgttacaaataaaaatattgtaaaaaaaatgtaatagtacatgtacatgttattagatactcgcctctgttccgttttaaaaagtcaagtaaaaccgatattgggttaaagcatttattctccatcaatggcagattcaggtggatatacgggagtttgaagttcttgtcacgtctaagtataatgctggcatctcttaagagattatagtgcaatttacttatttaattttttcatttttcttctttccacacatatttctaaaaaaaaatgagatgtagtgttgtcattttcctacgttacataatcgtgcccataatatggcaattaaggattcctattcgtaaacaaaaacatggtcatagtttgtggattaagcttccataaaaccaagttcgtagattaagccatgcatattattaggcactttttttttttttttttagaaattccaaactcaatttggagagtaaacttattatgataccatgtttaatcactctaaaaaataccatgtttttagaaactcagttataaacctaaatttacaaaaacatgcgcttaattactactgtccttaccatatattgtgctatggatatcacctagccccactcctcaaaacatggagcacaacagttagaacacaccatgatttatatatgaaggccactctaactagtaactaagcctttatttcctctacctactacatttcaataacaccaaaaggttaaaacttaaaacacagaagaactaacttaaaacgtatagcatcttggagtttatccttcgccaaatggcgtgttaattggggataataaggtacagtagtattcctggattatggtgaatgcaactagtgttgaacaccactgagttgttgacacactgcacattgctcttagtactgtacaaaacattcattattggaggtgaagatagtgttctcacagctttctcactcttgtgaatgggttgtttcttttgggattgggttattttcatttcaacacctatattttcccctgcaattgttatgacctcatgccattggcctcagaatccgaaggccttgtgtgaatacctttccctttcgtttcgttttctttgcttttttcatgagaggaag

SEQ ID NO: 6632 - DNA, 1000 bp, Glycine max
  Soy_ogl_1846 Gm06:8120001..8121000 Cluster 30
tgaaacacccagagaaaacctgaatattttttattttacgatgaaaaccagaattcaaaaatatttccaacttaaaaaaaagaagcgaaaatgaccaaatacaactcttgagtctcgaccattgaaatcatgtgtgtgtaaaaatataatttattagtgaacatatttagcttgtggggtggtggcgcagttggctagcgcgtaggtctcatagctactgagtaatcctgaggtcgagagttcgagcctctctcaccccaattatctttttcaccactttattaaaactgggtttaaatgcttcgcgttgacagcaagcaatccatttttgggcctattgataaccaaagcagttaacaatttcttcatattaaatatattaccgaaggtccattaacattgtcctgagcctcctttaagtagcatatcaatggggggtttcctcatgtgttaaagttgggagtaatgcccaagaatttcaccggtaacaatgggacaaaataagtagaaaattgtttattttattaaaataattttttaataaataagtttaaataaactgactcaatattgatatctaaattaagcttacctgattgagggagtcataggacatttatattatgtttgactatgaggaaagaaagagagatgaaagaaagtgaaaaatagagttgttagttagagatgaaagaaagtgaaaaatagagttgttagttagagatgaaaaaaagtaatatgatagataataaaattataaattaagcatttgtcaaattacgtttgtgctcatatttttttttctgctttaatattttttttaaacgattttactcttttgaaacaaactaattttgaatatgttgggtcttctcttagtctgctatattcaaatatgttggggggtgcatatttgaatttggagagctctcagcgcatttcgcttttctcacataaggccaattttgtaaatatatccctttcggtcatctttcttcac

SEQ ID NO: 6633 - DNA, 1200 bp, Glycine max
  Soy_ogl_2450 Gm08:1375801..1377000 Cluster 30
tgaaactatttgttaaataacaacaaataaagtggataattttcaattaaggactgtattgtgaataataaatcagagggatgaaagttgtttcatgaaaataacagatgcaacgtctgatactagtaatagcacattgtttgtgtatcccaaatggcctagctcattgactggaataaaggtattcttaggccattatcgttaatcacactgatacttcattcaactacttcatatcatccttgtatatgttaaattacaaataaaaaatcatcatccatctttaattagtaaaaggcgaaagaatatttcgctgtgtttatcacacggctctgtgatttatacaattacaaacctttcattttatagcataaacagttacttgttctagttatacttctcaatgtggactttagtcagaagtgtagacacccgcaagcttgacactatcccgcaagatccgagaaactgctgtcacattcttcctcagtcatggattatgaatactttatcttttttgttatgaaactattgttcttgcgtgttttgtgtgctattactactctgtaaagtcttttaaggcttgggatatctagcttgtaaactaggttgatttcttttaattaaggtggttgctcttgatcttgcagtgttagagactatatgaaaaacaacaaaaaagctacttgttggacagaaaaatctcaactaaagacaaaggagtaaatataggttatataattagaatgaaccataaaagcattttgtccaaccttgtatttctagtatctagtgcctacttttttgttttatcacttttatggctttgcttttctgaattactttagttttgaccgtacttgtctagctattgcataaaaatcttcattttactcatcagtgtgctgctatgcagatatcttgaagaaatgcctaagattgaagtttcggcattgttctcttgcttgattcaagccatttctctggcctgattcttctacttctacataacctggatgctacacctaagctagcataatggcatagcatgatatcgaagaaagtaacaattatttttattccctaaattagtttgcagacagagattatacataatctggctatgtaaatagataatagataacagtgtacaatcaatcagcataaccacaattaagttataacttaaagtaatgcctg

SEQ ID NO: 6634 - DNA, 1370 bp, Glycine max
  Soy_ogl_787 Gm03:1354031..1355400 Cluster 30
gctttttattgagagtgttatcggtcgaattagataattaatctcccacgaggtataaaagttatggaaaaagtttttttttttctgaatagttatggaaatttttttacttcacttaatagaatcttttttatatacaaaattatgaattgaactttaattaccatgtttaacggaattaactatctatctattatttgcattgagatttgttggtttgtttatacaaaagcctattggcttgcttttttgtgcggtatactagattttttttaatggaaactagatttttttatagtaatactagatttgatttttcaagagtttatgtggaaactttctattaatagaaatttttaaaaaaatacattttcttataaaataaaaaaagtaattatgtcttcaagtttttttattggtgagattatgtcttcaagttaatctaaacttgcatagttgcatgtaaaaaagaattaatacatatatgagtaactaaactttgaatataaaaatgttacattacattcgtgctatgaatatatctttttacctttaaaaaatgaatatatcttttaatgtgacaaggattgttactcaaaagagagattgggaataaactacaaatgcacgaaagagagtttaaaatatcatacaataaaaatttattaatatagtacttaggcctaattatattattgattagtttaatacttatgcctcattatattatttatctatgactaatgttcatgctcaacgatcacacgaagtcccgaagctagttcagagttcaagaaacaatggtgatttctcttatgtgtaacttagcatataattaatggtgccacatctattttattgaatgtaattggtcccaaagaaaatatgtctacttgccttaaatcaaataattcataactcctcaagcattgacacttgcttggttagaccataatcaattgatctatgggcgctatgataagtgactctacctagtcgaatggttcataaccctccaaacaatgatgagtcttaacaacatgtgtgttttattgttagtctacttggtcaaacaatccacaataagttgaatgatgcacatctttcaagtgttaagcctaaaaaacatgtgtaatttattatgaacttacttggtcaaatggtttacaacccctcaagccttgagcctaaaggcataagggctttattgttggccttcttggcctcacaaccaagctgaaaaatccatccctcaaagcattgagtctgaaaggtgtgagtgctttatggcaagcttaccaagtcaaatgatccacaatccttaatccttagccggaaaggtgtgagtgttttatggttgacctgaccaa

SEQ ID NO: 6635 - DNA, 1053 bp, Glycine max
  Soy_ogl_1086 Gm03:44645001..44646053 Cluster 30
tggccttccgaataaagggcttcgtttgatgacgtggcgcgtggaggaggcacatcgccttcctttccttcatcacaaccaggaactgatcatgtaataagcggaagaatgaaagattctactttgccctcttttatgaacaacctcaaattgctgtttcctgttgcttttaatctgtcatcttatcatttgaaataaattctaaattctgccaagtttgctggaatttggaaattctatctatgcattgcatttgctttcacatttagcttatgggaatgggaagtgttagtaaaatacactgtgatattaaagattataggcttaaattatttcagatttttttttggtaaatgattaatttttattttggctttttaataataaaaaattattatattaaatctataatatattaaattttgttttgaatgtttattgtctcatttgatgttcaacaaattataggaatcaatcatatcatataggaatcaccaagtcactttagtagaaaactaattagatttcatatcatataggaatcaccaagtcactttagtagaaaactaattagattatatctttatattatttttcaaatgcatttaggatatactagcgttagctaagctttactcaattgaatttcatgttgggggccgaaaggtagatttttccttatattgaaacccgaacgaagtacattttttttttccgtgtatgaatagcctaaaacaaaaattaaaatatattaagtgtagggatttttttttttaatatataggaatcaaaaacagtcttaagaactttataataattcgaacactcctgttcaatcaaattgaactgatcccttgacattaaattttttaatttaacctcaccaactgaataaaatttaatactattatttttagtcagtaaattatatatttatactattataattttgacaaatgataaaaactgatttataaacatttcattctcttgtagaaatcaaaatataagatttttttttgtacaaggaataaaacaataaattatgtaagg

SEQ ID NO: 6636 - DNA, 1300 bp, Glycine max
  Soy_ogl_3617 Gm10:48195201..48196500 Cluster 30
ggtttgatttgattttaggaactagctagcattccatggattgcataagttgaggttcaatggaagcattattaagtctcaaagttgtcatcggatcaaactggaagcgtttgatgcattttggcctgatagtagtgataaacaccatgttacctgtgaagcaatttgtttagggcatccagagagtggacaatatagcgttcatgacttcgtaaacagtctttgaaacattctactgcatcccttaatcatgactggtttgtcagtttttgtgttttaattgtaattacccttattagcctaagttttgaatatgatggatattttgggttacgtttaggagttacaaaccttgttttatcgtgacgggttaggatcaagaattgagtcttcttctctcacaattcttttcgggtttgatgttctcctttgtttttcctttttgagttttaacatgcctatatgtgagttgaccttaattttctaggattgggacatagtccttgataaccattggattttatttgaattgtctttgtgttcatttgagtttttttttggtaaggcaaagtgttcatttgagttatgttttttattcttttcttattgatgttatctatgcaaagcgattgacaatcatttttcataatttcatgcgtttaggaaataattgaaaggtgaatcttatagtttaaatcacaaaaataagtttaatcatttaacaatcaaagaattaacaaaaaaattaaggagtttaattgtatatagctatcacgaaaataaaagttaattcaattcgatatatcttcctatcctataagagaataaagattgccttatggctaatttaccttcaaacagaatcaactagaatactagataagacaattaatccaatagaaatttaatttacaaaccctaatgctaaaaggttttcccattaattttccccaaaattttaatcgtttgttatatttcaatttttaattgcaacttttctaatcactctaaaaatctgaactacttcttcattaattaagtaatttattaatgaagaaaaatctataaaaaatgatctagaaatgtcaatgataaacagtgattgcaatcgatagacaaacctggtggattaataagttaaggtggataaataacttactactgaaggtcttattgaataagaggacttatgtacaagttaattttttaatcgaaagaaaagtagggttaacctattttgatataagctattttcataagctattgagaaaagcttattgaaatagcagaaactagctta

SEQ ID NO: 6637 - DNA, 1179 bp, Glycine max
  Soy_ogl_3689 Gm11:2337939..2339117 Cluster 30
tttttcgtatgtattttaatctttttttgtatttttgttatcactaaaataaatttatgttaattatttttttttacataatatttataataataattttttaacaagatagattttatctttaaaaatttttgaaactagaaggataaaaattactaaacaatttttaattaaatgtaaatttaaagtataaaatattttttaaactggaaaataattgaacgaaaaaccttaattttgcatgttcatatgtgcaagtagattaaagtttataaaattaagtttgatttaaaagtttgtaaaagtattgcaaaatttccttctccaaatctgagttttcaaataaaattatactttttaacatattttgaagtgtaactaaatatgattttaaattgattttactctggccaatggatgtagcttagtggataacataggttgaatttgtgaaaaagacccaagaaaattttaaggaactcattttatattcttgaatcatgagtctcgtgatattacataggacgaaaaaaaaaattaaacattttttcaattcttgaattttcactttgttataaaacactccagtaaaaaatctaagcataaccttagtacaataacattgttaggggtccacaggtatgattgaggttgatctcacattatcttgaagcatcatgcacacgtgtgacgtgtgtcgtgtgcagagaactagctgtacacgcagttggaagcggcttgttgggacttcaactctttctactgattatttatgacgtcagttatcagtgcatgtaatggctctctgaagtttgacccacaatatttcattagtgttaattttcttattattactgacctgcataaggtgagtgggaggaaggatttgaggctattttaaaagggtgaaagaagaggaaatagcaggtctgagtcacttccaagttccaaaaaacgtgtagctgggaagaatcctcacacagaaaaattattattcgttttcaaaaacaaaacaaaatcaattttgttcattacttggctgatggagtacgctgcacgtccaattccaagtcagcgctatagctggaactgggagcccatgactggtgacatcaagcgtttaccacatctaggtttttctttagtaaagtatgattttggtttttttattttattttt

SEQ ID NO: 6638 - DNA, 1000 bp, Glycine max
  Soy_ogl_4423 Gm13:33367501..33368500 Cluster 30
atcatcactttatctacgcctctctctctctctcttcatgattaaaaacaatcaagttgagacgtggcttataaagtgattgattacatctttatcagagtgatttacatgctagctagtccctgtgcttcaaataagtgtttactggctactgctgttattgattcaattagtccaataattaataagggtccacttggggtcaggagtctcataatcttgaagacataattttatggacaaaaaagactaaggacataattttagagtagtaattaattaagggttgtaatcatgatgatccttcaattccgttgtccaattttcatcaacttacagcacacacacacaaaaaaaaaagtgttctgagaaaaaaagaaaatagccccccaaatatatcattttttcccgagatttatgagcatcatcttaagctacacaccattgcaggagaacatatcctcatgatgtataatataatatttctatgcgaacggggagaagaaactctaatcataagtatattaaagtgctttgcaaccaaatataaataaataataggaccagattttactctcgagcttttattccctcaagattccccctcagaaaatacaaaataaataaataagaggaacaatgtgggttaggaattaaaaacaaatgaagctacaatacctatttaagagtacttaatactagtttgacgagagttgaaaatacttactaaaaaaatttctggtcaacgaattttttaggatcttatatgtctacatgttataattactttatttctccagcaaccagcattgaacatatacattcatacatatgtacgcctttgtacctatgaagatggtataaatagctctttcctttcttttcaattccatttccttggtgcaataaaatctcattgcatcttgttaaaattgccttcaattacttgaagtcaataaaagtaagctctctatattaaaatttcatttccaaaaactac

SEQ ID NO: 6639 - DNA, 1109 bp, Glycine max
  Soy_ogl_4570 Gm13:39382992..39384100 Cluster 30
tattataattgaggcggcacaggccgttatgataaaaagaaatgtcaaatcaccagacgttgattactggtcaagaaaaaactaaaaaaccttcaaggagttgtgttttatttaggtggatacagttcattaaattttaaagctactagctagctatcagtgatgaaacttgaagagtattgattaaacgtgaacaatcggaaaagttctccttggcatgcattcgccgccaacagaactacagaaggtttgattataagaattaattaagttcgcattgtttagacttttaacatggtcactaggtcaggactcaggacggattaaagattaccataccaacgttccttcatcttatttgttatttcgtagaatcatgattatttaacctacattaagcttagactaggccaaacattctctaagaaacaaatttttataaaagcctatttgattaaaataacaaggttgtgttaggaattatagtatagagttattagaagatatttatatagttagttataaagaagggatgaacatgaagcacatatggagctttgagcccctatccaccctcacttggcctttgtcatacgtttctttttctaatccatgctcccaatttcaacgcagattttaatttaagtataatcatagaagacgcaaccacaagagaaaactggagcctgtctagaccgactaaggtggtaacattttcacaacaatttttaattctttcttcgttattttatttcatttctttttcttatctttatctctcttgtgtgtgtataaattataaagttttattgtataaatgtcattgcttatattaaaattaaacaaaagtaaaatacacgatccttcacattatcattcatcacatattaataatttgagacccagaggaagaagaaaagtgcccaaaaaattatgaattttaatttgttagattcagaaaatcatgtattaattcatgcagtcaccaatattgaaatctttatattaacatcggacggttcaaattatattatcaataacaaagcaacaaaaaaaaacacttaaaacatgaattggtaaatttttattcaacaatttcaatttatatg

SEQ ID NO: 6640 - DNA, 1031 bp, Glycine max
  Soy_ogl_4586 Gm14:405570..406600 Cluster 30
cttgccgacataaaagggtgtggccactggcgcgccagcgagggtatgcattacatgtcgtgcaaattatttatagaacaattcattcttcattgcacccgttagttagttagttcgttccattgcaaacaagaaggcttcttcatcatctacacttacctgctgcttctgattccctcccataactgcttcctcaatgttgttctaccactgccacatatttagaaattgtctcgtacaaatacttggtttcaacttttctccatacgtcataaagtctaaaggagacaccattgttgataaatgaaattctcatgattatcctatctaacattttcttaatagttcaaatgtactcttgttttcaatttcattgtgatataaaaactttttttagtttgatttttaccctttttaattttactacccctcgacttaatacccatattaacgacagtgtatctaattagaatttgtttatattcaaatctttaaatttagaagaacaagaaaacaagtgttttagtgttcaaaccaataaattgtttcatttgataaatgtttagaatcataccagtatggtagcacaattttctacaaacataaatctacataaaatgtattttctactcaaaatataatctatatatatagtgagagagagagggagaattttatcaaatgttcgcttttaggttccaaattcttaaatttatttcacaccccaaataatgatttaaaagttttaacttgatttactttatttttaaataaaaaaataatttgcttaaaacaagttaaaataccaaaatcacacataatgtatccagtatccgaacaaatatataaacagaacaaccaaactatatatcattattctaaaaagaaagagtgtttttggtcaatataaacagaaacataaaaaataaaggtatcgaataaatgagaccaacaatggaactttggagaataattccaacccacttgagggttattcttcctctacctaacaaattttttttatacctaat

SEQ ID NO: 6641 - DNA, 1100 bp, Glycine max
  Soy_ogl_4815 Gm14:48139301..48140400 Cluster 30
catggtgagttcttagtttcttacaaaaactacttctattttaacatgaatatactcttcctaaagatatgaggattcaaattccttaacaagttgttttccttagtcataattgaccatgatgcactaatctatatccttgaaaagcacggttagtactgaggacatttagcattgtatatttcatagttaattaggtacggataggtagggtttcactttattcttcctcacttcaatttttcacataaagcttttgttagggatgttacttatgacagatagacaatcataacttaattagtcgtaattgtacacttacaataaaatccaacttttctggccgaaaagaatcaaattcaatgctggagcgagttaggttttacttttattggtatgaaactggatgctaaaataattcttacttttattggtatgaaactggatgctaaaataattcttactgttattggtatgaatctggctactataaaattacaagcagttaattctacatccacattttgtatacaataaggtatgatatcgataaagatagatagatagtgaaattgaggcaatatatattaaccataaacatgtatgtgatgatagccagaggaagccattcaagtgaaagtgaaagttggttctttaacaattccaccaactttaacaccattcatccattaagaatttagagttaacagacctcaatccttctaaatggcttaatatatatagaaatcgtgcttgatgtagaacagatccatagtattattagtactttttaccccctcacgtaaaacatatataggaagctaataacatcatagtggagattgaaaatagctgaagattttgaaattaatgaactcttcttctatatatgtttcttgctaccatgaaaaatatattgaagtattccaattaaaattttagtaaagctattcatatattgaaaatactattttattaacaattagtattataatatttagtgttttcttaatacttgtgtttgttattattgatgaggttataattttaattaaaactaaaataactgaagaaataatatttgaattgattaagttttt

SEQ ID NO: 6642 - DNA, 1000 bp, Glycine max
  Soy_ogl_5210 Gm16:613201..614200 Cluster 30
attaataaataacaagactatgttacttttgtcatcacattattcattgttcactagagcttatccctattaaaaatctaatatctagagcgagtgattagaggcaaaaaaaatacttgattctcggttttaaggacttgtgcaattcaaattattctagcacatcagattataccttcaacaagtaaataatttaattagtattttaaattcatataaaattatatatttgacatgattcttcttacattttgtaccatatatttttaatgtgcaacaacgtttgaacctaggaacttacgaaaactacccaaaatcatcgtcaacgtgcttaatgattctattgtgttctatattattaattgaatattaataaaatgtatgtgtattgtgtaaccaaaaaaatgaacgagtattgatgagtaatatctagtatgagtactagtgaattctttcattcgagagactttttcttcttcctcggtgtcttaacattcaccacaacattcctctcttcttcgtacccttcccattttatgttttgataagtcccttctcccttcgtgctcttagtcctcccctacacatcagaccactcacctttgttctcttcgtaggcaaaaaaaatgcgtgtatgtatatcgtcaaactagaatcgaaacctaagatgtatgatggttacactatcatcaagaacttatcagcatgattcacaagtcgcaaatgatatatatcaggtcattcctaatgaatactagggtaaataattcaataagccgcaaaaaataagtaacctaggtgcacaaacttaattacaaaaaagagagtggtgtttctttttgttgggggagattcataaaaggtataccttctttctgcttcttatttgtttacattgtctctttttaagcctttgttctctaattttaggggtgtaaaggttttgtctaatttggactattatttttataagtaaccaattaagttaaatcatcttgac

SEQ ID NO: 6643 - DNA, 1100 bp, Glycine max
  Soy_ogl_5214 Gm16:770601..771700 Cluster 30
agcgaaatgtcatcgagggcaaacaatgaaaagttagctctcacgggtttgagaacctatatcaaaaagatacatgatcagtgtagtaattatacaaaccaattttgtaaaattagattaatcctacgcctaaaatttaaaaaaagtaatagaatttatcctagatctatggtttgatcattagtattaccatactctagtagtcacagttttttgcatacctctttgaagagattattgatggggtagtagtagaataataaaataatattcagcataaaaaaaaaaggatatatgtcttataagctggacttagaccgtaatacaatttcacaaaagttgcgtataagttgaagtttgccaaaaactttacaagaattacttaggtcttattataatagacgtgggattaaatataccccttatacctaactctatgggaagtgaaaaatgatcgtttttaaagtgggttaaaggtggcccaaatcaaggttgatttccaacacaccctctcccccatcaataatctctgcagggaagaatgcaaaaaactgtgactagctaatgaagtttttttttctttctatattgtgatgtctctgtgccatatgataggaaagaacagataggtattgacgactttgactctttgagggtttttgattcattcttcaattaaggatgaatggatcgaataatcaagatgtgagttgtgctgttaatggatatgaattttgatgaacagcgagtagcagaccagcttataagaaccttgttcttgtgatagctttgcagttggaaaataatgttatttgaatgaaaataatacgaggacatattccaggacaacaatgtatagttgttgtttttttacataaatagaactagctcatttcattcatgatagaagaataaatgcatagaggtatatgctaatgtatatatataactatgagaggagcgatgaaattgttacttttatgagcacgcatgttccatgaatttttcagttgaaaatatataactataactatataatacatttgaccaccatgtccaatgaatcaagttattcaatttacttaaactaatcgaaatta

SEQ ID NO: 6644 - DNA, 1100 bp, Glycine max
  Soy_ogl_5547 Gm17:6329301..6330400 Cluster 30
attagtaaatctggttttttcaatagacaaacattttatttccctcgatgttagagtaattcaaaaaataatatataaaatgataatataacgagcaagagaaacataaatactaacattttttcacaacaaaaaagttagatcctttccatttcaataagagggttaattctttagtaaaaatagcatcatcaggtattgtattagcctgtcttctaacaaatttggtagaaaaaaagggataattactcataattttctttatttcatcaaatactagcatttaagaagttacaaatgattttaatataaaagactaaaaattaattattttccttaatttatgtttttttttattcattcttaatttgtgttatactactgtaacgtttacaaaaagaaacagccagtggggtagtcggatttaaatgtctccgtcacaaccggatatgcgaacaacataatctataagtcaaccctctctatcttgaaaaaagaaagtaaactctctctcaatttaattattgcataataaaactaaaacgattttgcttttattgattattctaggagagaagattccattaaaaataatgaatgataagtctggttttcactccaatattatgataactggtagatactttcactccagtgatgactcaaaaaataatatatgaaatgataacataacgagagagaaaaaaaaaacaaatactaacatataagaagttacaaatgattttaatataataagcaattaaaaattaattattttccttaatttgtgttatataacgtttagaaaaagaaacagcccgtagagtatttggatttaaatatctccgtcacaactggatatgcgaacaacataacaagtcaatttaattattggataataaaactaaaacgattttgctttaattaattagagtgttgaaaaaggttccaattattaattacttgaaatgttatgagtcgtgagaaagagtccgggacaattaataatcgaagcaaaagttacacatgcacaaaagaaatagtgctggaaggagtctctaattaacaggttaatttttctgattttctctatatataac

SEQ ID NO: 6645 - DNA, 1128 bp, Glycine max
  Soy_ogl_6183 Gm18:255373..256500 Cluster 30
gtgcataaaacatatgttttatgtaaataatgctaactttattaaaaatgatatataaaaaattaaatgatactatttaatttttattcattaacaatgtataatgtatttaattatttattagattcatgactgttcaattaatttgtggttgcaaaccacacacacctgataccacatatatgcaaaccaccactttaatttgccttgttggtgttgaaccgaaggttcttcactcatccatatatctctccaattttattttaaaaccatctagatatgccaggataaataaataatcaactttttattcattctatatttaatgtttgtggtgttttattttaaattttctttatagtaaatctcatgttcccactttatttatttttcaattccttaattcatttactaaatacttttttgttgtagatagaaaatagatgcccccaacaaagaaatacaatttttaaaggaaatatagaaaccccaacattcaatgcaaaaagtaaccaatgagagttgttgtaaactaaactaacaatcgtttaaataataaattcattataatttaaaatgattaaagtaaataatctgatgttggttgcaaaatttagatattattaaacatgtgcaacacttgataataattaaatatgtataatttgaatattaattatttccatcatatccacctacacagctatactcttatacagattctccatcggcaattctgataatgattatacataaagaattaaacaaaaaaaagagaagaaagtttcacataaattctcttataacttttggaatgtgaaacaaataaaaaaagagattaaaagtattttctggagcacatgggctcaatttggattggtggtggctgtgctagaagatacagtatattgtcagacaacaacaaagtaacacaattggtatgaatacaaaatgagaagttgttccacacttaactcaatcatagtgtgccatgtgtgtcttcggccttatttaggcttcaccgtgtgcatagatattagacactcctttccacgctctttttttcgtggataagcttcatttgattcatatcctatttaggtggattttttttttaaaataagaagt

SEQ ID NO: 6646 - DNA, 1100 bp, Glycine max
  Soy_ogl_6585 Gm19:44986101..44987200 Cluster 30
tagatcaaacatttaaaaaaaaatacataacaaaaaaacttgttaatttatgttatatatttttaaccaatattgtactcaaacctagtaaaacttaacctaacatatttccaaccctagatataaagaagagttatagttccttcaataagcatagcactaatatgctaattgattattcttctagttatcctataaatttaggacatatttatctttcaatcaattaaattaaatatttttcttaattttaataagcattgctggtcaacttaactaactaacaaattttagataattaatataattaaaatagtccattactactatcatataactactaatcctaacaccccatagcaaggtgataaatggcataatgaatgataatttctgccagaatcaaacgacattttcttgtcttatagcacaatctactctagaatcccaaagatctgcctttggttatcacgactctaaaatggcttgtggcatcaaaatctggttatggagttgattccgccaagtcgtggaccacaacattcaagtgctttgtgttgaaactcttcaaatgtcgcttccaatattttttgtagagcttatggaggacataattgaagggaccctaatttgtcagggtccaatttggaccaggtctatcccacaagatcttacgagattaaccaacaaatctcatatgaagttgttttgcttcttcgacatcgtactgcacaaggaaccatttctcctctgctattggttttctcttcggaaatgacaaatgttgaatgctcatgcaaggttgcaaacaaatcacatttgccaagtaagaaagagaaaagagaggttttggtgaaattagattgtggttttgtggctagctctttcggattcgacatggttttgatgaaaccaaaattaatttgcatgtctgaacggagaagggctaagaaaatggtttaaggttgaattaggtcagttgaaatctaacggcccggttagattcaatcatcagtcataagttccatttcattgccaaaaccctatatgcaggtaaattatctattttgccacaatttagcaaaaagggaaaaacattc

SEQ ID NO: 6647 - DNA, 1121 bp, Glycine max
  Soy_ogl_6632 Gm19:49783201..49784321 Cluster 30
tgtgcataggggcaaacaaacaagttagcataattttttttttatgggattgaaacaagttgttagtgaatttggcatgcatgtggaaatggaagccaccatttgaatagtgggcacgtatgagtgcatcttgtcctcacctcagtggaggaggtcaactggtcaagaaagcattccaatggtgtcgccatacacgctcatgccactgagcatttaaaaaccttagccccactcgcagaacttattagagactgagttctgattaacatacacggcaaaatggaatgtattgaggtgaaaaaaagagcctgataaaatgaaggaaaaaaaatggaacggaatgaaaatattaaaaaaatatttgtctataattattgttgaagacacgtatatccagatccaatagagggacaaagtagaattggactagtcccaaagtcgcttattggcctagtatatgtttggttgcgagatagtgccacaaaaatcacttaaaatactattagaagctataaggtgtgtgtcatggatctgcctccgtaaaattaataaattttataaaattgattgtaaagtgattaatttaaatttgaatgttttattataaaattaatttaggagtaaatataaaattttgtaaagttgttttaatacaaaatcaattttggactcaaaattaattttgagttattctttaatatgaaattaaacatatgaaaatatatttaaaatcaattatgaactcataatcaattatgtaatatcaaaccaaacacgcacaacaagttgtggcatgacattataaatgtagaaaaaaaaatatcatagtactttcacagcatcaccaaccaaacacaatgttgaaattaagaaaggattagtttcttataatataatgaatcaaactttaaatttagtattcaatcgtatttaaaaaaaatgatgttagagtatacatctgagaaacaagaaaaaaaaatcctgctaaacttaatacaacacttattactgaacttaaactacagtattaataattcatgtttttctagaaaatttttctaaaactaaaattaataaaatattacttaagtctaaacaaagattaactgaaaaataagtgc

SEQ ID NO: 6648 - DNA, 1262 bp, Glycine max
  Soy_ogl_3011 Gm09:5320201..5321462 Cluster 30
gtttagtaagtcatcagtttcaagaagatagggcagcaattcttccaaacccagatggagacagtgtcattgtcagcatatttttccagagacagcacttatgcagcttttcaaattagtcttctacgaggatatgtatgtatcctagttatagcacatatttggagctacgaaatatcctgttagttattgtgtccaggactactgcaatgattgcagtttaatttcaaagttctggttcctcgtttttagatgttgataatgtatgttcggtttttctttattaagtatgcttgatcgtgggctgactagagcacagagcacatgatctacaatcaataatacatgtgattttcctatatattgatagaataaaagtctttaatagtgtatgaaatcaaacaaatattagaagggttatgtatttattattaacttagagagttttgacagtacgtatgttttgttgttgtctggcaatctgtgactctgtcttataattctttcactactcattaaataaaaaataaaataattttatcttataatacccaacttaatggttaaaagatatatactagctactatgccccagtaagcacggatatttcgtaaccattaataaaacccaccaccagcttcagctaattaaccaagaaagacccacattctatacttaaaacaagatttcaacccaccacaaaaaccaacacccgacgtacaatcggcaacaccagacaccaatatactttggagtaattacaagccaaaaccattatagccatacacgtgattcccatgaaaccctacataaaacactacgccgaaagtaacttttggttccttttaccgacaatgtaaaagccactaaaacttttggtggcaattgtcttaataaaataatagcaaatgctattaccctaataaaaaaaaagcttgtatactttaccacttaccctaataaaaaaaagcttgtatactttaccacctaactttcatgattatgtaaattttaggatcaaacttttttttccgtaaattttactatctaacttttatatttttacaaattttactacccaaatttcattttcacggattttaccttcctaaatttttttattttatgaattttatcatccaacattttttgtgtattttacattggtacccccaaaaaattttctacaaaataagttttgaatgaattagtatcttttatcttttatcagctaattttattacattaattaataaattgc

SEQ ID NO: 6649 - DNA, 1000 bp, Glycine max
  Soy_ogl_3293 Gm10:954101..955100 Cluster 30
tatttttcaaccaaattctatcgttaaagaataacaactaccaaaattactgttcaagatagttattctaatttataaagagaaagagacttaaataataaaatgtttattttcattttttattttcttatatttattttttaaatccaaacaaaacaaaattggatcgggagggcacgaaccaatcacactggttaaagacttaaggtttattgaggtacatagcttaataaagtatttattatatatatgtttgattttatcgcaattttaaaccgttgatttttttaatagtgcactttattattatctaaaagattcgtaccgggattttctttttgtgatacatcagaaaactaaaacagcaactcctaagatgcataactcccattacatcacaaagagtaagagaaattaaaggaggataattggttcaaacaagagacacattagtaagccaatctaaacagaagttagcttcacaaaaaatatggctaaaacaaattcccactcaagaaataatagatcatgaatcatcttattagaggaaaataaagatgaaaataatcactggattttagattagagtactagagatttaaaatggatggatgtaggcatgtagctagcgtacgattgaatgtgcgttatctattcttatgatgagggtatttctttccttttctcttgcaattagatgagtgtagtattcatttttgtgattcgtttgtcaatagttacataataaattccagggttgtatgtatgtatctcttaattatgatagtgtagatctttccttaaaatgatatgcttatttgttttggagcgcaaggccatgaaaaaaaaataagtggaacagtgtgaaccataattcaaacgtaacaccaaaactccaaaagtgaaattattttgccccttttatctacggcggaaaagttttcggcttctcgctatgaatgagctttcatggtactaatttattccttgcacttatttt

SEQ ID NO: 6650 - DNA, 1000 bp, Glycine max
  Soy_ogl_277 Gm01:52067701..52068700 Cluster 30
actggtttatgtcaattttatcctttaaacataattttaaaaggaaagacaattaactcaaagatgtaccatatgtcctgctgttcattctcgtaatattctactaatacactagttagatgccgcaagagcataggttgctcgtaaaaatgctatttctcattgttttgtttattgtaactagctctttgatgtttgatacaaatgatatactatgctatctgatacaatgttagcacttcattgacaaaagtataatctctttctttctatcttggatggtaagaatccaatgaataataaagatggttgattcaattcgtcacgatgggtgtgtagttgtatatactgtatttggttctaatttttttttaaaaaaatttgttgtgcagtagcctgtgacattgttttgtctcttattcagtggtagttcaaaggcaaaatgaagtttatgtaatttggaaatatatatacccattaaaatttagtaacactaagttagataataaagaattttccaaccaattgagaaataaaccaccaaagttattgatcttgagcctttacaaatattcatatgactaaaacatttaaaaaacatttgccatagtatgtgtcttattcactattgttcatttgaatcttaagctcacagaatgtttttttaactcttaatgctttcctagaaatcatcacgaacgaacgtcaatcatttcttgcaaattcataactgagagtgaataataaaactttggaagcttgccgaactcactaatattagatccattagtcgcactcacaaaaaaagtcaatattgaagagcttctggtttacctaaattaggtcttgctaaattgtacgtgaactgtttcagctctaaattgtacacaaatgaagttgtataaaaaaaatttagcctcaaattgtgtaggcaatcattccttccacaattgcatgccctcgaacttaaatcgtcaaggacctaaatatttaatcatgc

SEQ ID NO: 6651 - DNA, 1087 bp, Glycine max
  Soy_ogl_1011 Gm03:41286601..41287687 Cluster 30
gatcagttccaacaatttcctagaatattaacttttgaatacagaaaaaactgtttaatggtatattatagttaagaatgtgtgtgtttgtggctgaaaatggagttaagagggatactagcgaggcttcctttttataagggttggattggagtgatggcaatgttaattcatgtagcacacgtgaaaaatattacttttagtattattggcgtgaaaaatattggcacacatacgcattgcaatttttagcatatacctaaatgatggccacaaactcacaactaacgtggtgattacttaatgcttacgtctaaatcaccacccaccgacacacaaaaaaggaaaatgtatatatttttttagaaaaaggaaaaatatgcttacattacttcatttgctagtcacacatatttttggtaagtatcacgattcacgtccattacttttacgtttctatgaggtgcatgattatgtctttaaagttaaaattggttttgttaatattcatcaaaattaaagaagtgtttgagctcgacttctttataataaactcgtataatattttatgtaataaaattttatcggttggtgtgttttcttacactaaatttaatctagtattgaaacatacaaacaaatattgtttcttttctatcacttttttgtatattcgtttttattttttggggggcattgttgtgatgttccaatatttttctgaactgaggacatgaattcaaacacaccgttatctgttaaaaattacttttagtgcatgactattgtattacacaacattattcttctagttttcaataatttgaaagtatattttctttcaatgattttttaatacaatcatttggttaataatatagttcgttctagtttagtagaattttagagatacttttctaaaagttttggattaacgtaaatatcactttttattataaatttgtgaaagttcttgtgacatgtgaagttagtgaccaatattcgtaaaaaaaaaaaaaaaaattaactcaatatttgcaatcttggatctcaaaaacgtttaatttatcttatgatatgatgattg

SEQ ID NO: 6652 - DNA, 1245 bp, Glycine max
  Soy_ogl_1138 Gm04:528056..529300 Cluster 30
tcctatcttaaagatgttttaaccctaaaaaaaacatgacgtccaagattgtgagtctcataaaggaaatgggtgctaaggaaattcacatgaggattgcgtgtcctcagattgttgcttcgtgttagtatggagtttactcgttgagtcataatcttttcctttctaatcacggtcatggtccttgcaaactatttctttttaacctcatcaattcaagaatactatttctttttaaccttattggttgacaatctattttgtaggcagcaggtgtatatgatatcatggagggagcaacaaaaagatttcacttatgtgacacaaataggggaacacattctccattgaagaggtatcaatatgaatacatagttattaagaggaagaggaggaggagacaaatgaagagatggactgcgtctatagagtaaaagcggaagtctggatggcaaatagggaacttggttatgcaaaatgttactttatgcctttggttcccaatagttttattatgttctgatgtgtccttgtttagattgtctttctctatgtagttttattagtttatttttcattgctattggtatttgttttttttttttgtgtgggaaaggctatatgcacctttctttgtgcctcgtttgaactcataggaccatttctttttaccttacaatttttaataaaacttttatttgcctataaaaaccactatgaaattggaagcctatcatgtgaatattttctttttgactctcatgcttttgatcctcatcaatttacttcctcatgttgacctaaaagataaatggagaaataacgaagaagtgtgatagcaagttaagtgagaattatctgctaattgatatttaaggtaaataaacttctatatggtcttcattatgttttctactactcataattggatatagattactggtaggatttgaatctttgctaatttgaatagaatttatattattcaaacacatgaatctcaagttttgatgttataggattgtgatgcattggtgttgccatgtgataaactcggatttggttttttttttttactgagttttcatgttaatttaatgtattttgacatttttattaacaaaattcatagcttgttgtaagtttgtgaaaaacaggtgatcaaaattactcaaaaaagtaggattcatatcactaattatctcaatcggtgctctaaatagtgtataagttttatccatgaaa

SEQ ID NO: 6653 - DNA, 1000 bp, Glycine max
  Soy_ogl_1406 Gm04:44884501..44885500 Cluster 30
aatggagacaaaaatttaacaaatgctagtgatactaaaaaaattactaatttttactattaacacggtaagtttcatgggtactaaattacatgtctcacaataaaaatatatatgacacaaatatataggttattctttagtgttagattttgattcgtgttctttcgagtttctattattgtgtactaaattacatgattgttaattaatgaataatgatatattgttaaaaaatttgttatgcggatcaaataaaacatgatttgctcaaattaatgaagaatgatatattgtactaaatatagaaacacacgtctcaacattttgaagcaacacgtctcaataacatgtttcacactaaaaatgaaaacaacctatgacactcgtcgaagttgcaaggtcttagaaattagaaattacaggaacatctcaataacatgcatgtcttgcaatataaataaaaacaacctatgataatgacaccaaaatatttcaggacattctctctttccccttgctctggtcacctccttgagcagtactaaaggagcgacacaatataggttggaacttcagaatctcagggtatcgaccaaaaaggtacaagagattcttgtgatcactaccgactgaaatcggtaaaaaaaaaaaaaaaaactttcatgactagagaagggtcattacaatgaaaagataattaaatttagaaaaatataaacatcacataactaattactttgttagaagaagaataaaaataaaaaatgctaattatgccctaagaggttctctagggcctcttctaatatgaaaaccaagattgttaacataggtgcccaggagtgtggtaaaatcacataattggcggacaaaatagtaaacattaaggctcctaacttttaaggtggagatcaacaagggaaagtatagataaaagaaccttaagcttgttaaggttcgacaaagcttccgaggggtaatttccctacgtagcaac

SEQ ID NO: 6654 - DNA, 1000 bp, Glycine max
  Soy_ogl_1536 Gm05:1966901..1967900 Cluster 30
aacaataataatcactacataccacgcccagcttatatatcaaatgaaactcaagtcaatggtcaatcctataaccttgacaatttgaatttaaacctgagtcaataattaagaaattaaattgttcaagtatagatggtaggattgggcaaataagaacttatagttgactagttccttggacacttacattgtttgattacttggaaaacagagggaagaaaattttaggcgagtctaagtctatttttttccttcttacgagaagaaaactaaagatgcaaagaaaaagaaaagagaataatcaaaagttaccacactaaaaaaatttaacaagtgtctttttactttaaaatgttttatttcctcttatttttatgtgtaataaaaaaaaaacgaaaagttaatatttgcttctttctcgcagagaaaatgctactgcaattagagataaaatatgttcttgataaattttgcatgaacaaagcaagatcaactacccaacaaataaagtatgttcttgataaaatatcatagggaagatgttctgaaacttgttccgagtattctcaatgatagagctgacccgagtcccataaacaagaccttaatcgctctcataccaaaagtgaagaagcccagtcaagcaagtgagtcccgaccaatcagtttatgtacggtgatgttcaagctagtaacgaagaccattgcagatcatttaatggagatcttgagcgaaaatcaaagtgcctttcttcccggtccacaaatcactggcaatgctttgctagctttcgagtgcttcaattatatgaagaaaaagacaaaaaaacaggaagggctttatggtgattaagcttgatatgtcaaaagcataccatagagtggagtggacccaccttgaaaatgtgcttaatagtatgagtttctcagcaaaatgggttcagctaatcctaagatgtgtcactactgcttcttttgttgttcttgtctatgtatt

SEQ ID NO: 6655 - DNA, 1000 bp, Glycine max
  Soy_ogl_1552 Gm05:2449701..2450700 Cluster 30
atagtattttttaaaatttattattaattttattgaaacctattcatcttcttcgatttccatacgagtgagaaaaaatttccatgaatacacagcatgaatctcctccaccacgttacagcaaggatgatctctactgcaatttccatccaagacctggattgcattcctggaatcaaaatcaactcgaatgaaggaaaaacctcttgaacgagctaatttgatcctaaacagaattgccaataatttcgtatgaagcaccgaactttgtcatatgttggcttgaaaaccacaaataaagataccagtatgatcacggggatcatgcactggagcattccaacgtaagtctccctggttgcaagatgaagtagaaaattgaggaagagaattgagcatcatgtcactactcagctggtaggaatgggcaaggttgcaagccttatgaataacatcaatcagagaccatgtttcatggcaaaaaatggtcctaaacaatgctttatgaagtagatagcctttgtaggatgaagaggaaagtcacgaagtagcaagcagtgacaaataaagtagcccatgaactgataaaacgagtgacccataaataattttgtcttctttccttctcctttctcttcacataagaggggatagcttttttgtgtggggtactctcaaaagttttctttccttcaccttttactgatactacaaacaaaagaaaaggtgaatttaagcaaattttcgttcatctcccaaactttccttcccttttcaatttatttcaaagatgaatttaagagtcctgagcttaatgactaataatcattaaaataatctctatctctattttctactatctttgtgttaaattagtattttttgttagcaatccacatgtccatccaatatgatggggaatggggatacaacacgttagtaatcaatcactttctttaatattatttcaagaatacttggacatctttatggtataatc

SEQ ID NO: 6656 - DNA, 1000 bp, Glycine max
  Soy_ogl_2896 Gm08:449251..44956200 Cluster 30
ttgtcggggtttactttttataacccagacaagaccctagggatatatatagttaaaagggttagtaaatatcaatggtccctgtacacatacctatatatcgtcctcattaatgacactgccacggtttttgtcttttacaaagtactagtacttaagaagtgtctttaaattttaaaatacaagttggaaatagaataaaagtaatctaaaataaacaaaaaagtagataaataaggggtttgacaaaaaagaaattatacataagaatcaaatttaaatactaaaaaatatatataataactcgggaatattaatgaatcaactacattacacctgatagaagataccttgacgggtaacattttaccataaaggcccaataatccaacaattctaatattcttcaaataattttttgaaccgaaggttaacattacagatatatagaatctcatgatctaactattacgcgcactactcatgttgcgaagatacggagataaagacggatattagcacgatttttatttttatcataaagtaaaatgcacatgaatatatttaatcagaatacaagttaaaaaaaaaagtacgttgggattagttaattaggggtttgacctagcattacacaaaggctcaatagccttacgataatcgcattttgtctaagagatattttctaacactactgaggacaaacaagctagacaagtaggcctcatgatccccattatatgcatcaatttaacatgcaaagataaagataaaagatgaatgatcttataaaatgtgagttgttaacatttttaggtaggcacgtcttttatcctatgtttacaggtgaggaaaagaaattaaggggaaatgaaagagaatgtgagaaaataaaagaagagagataaggtggaaatccagatttttttgtcgaagagaaataagtttcatacttttaatttacaaacataaattattataacttttaaaataattttta

SEQ ID NO: 6657 - DNA, 1015 bp, Glycine max
  Soy_ogl_189 Gm01:47914786..47915800 Cluster 30
agatttaaatatatttttgataattgtaagtgttttttattttatttttgatacatgtaagtttatgtttttaattggagtttttgtaagtttgtattttttaaattttagtccttataaacttgaacttataaagattataaataaaaatataaaaattttaaaagatcaaaattaaaaaattacacgtttacaagaattaaaaataaacaaaacattgcaccggaatcaaaattaaaaaaaaaacttaaacttatcagaattaaaactaaactttaaaaaaaaattaacttacaaaaaaaacataattaagcctatatataaaccacacattaagaacctaccgccttttcatcttcatcgttgtcgctttcgaaaggtgaaggaggtgaacaccaaagcatcgaacttccagacctgttaagattgcgtgactatacaattcctttttacgggtaaaaaatcctttgccacgtgaattgaaacacaagtttcaaggcctcaaaatgtttaatcactccgtagtattgattcatgaagagggatgcgtgctactacaaatatatcacataagaataagaatcacaacatagcgatagtcgatataggaaccacaaatgacaattaacatggctaaatgaagtaacttaaatggctatttggtttcaacaactaaccttttccaaatttggattggatggataaagagcaccagtattcacatcaaatttccttccgctcgcccctgatttcgttaacttgctataatttttgaattcttcatatgcgatagttaagtaatgcacaatctgaaaaacaatacaatatcattagaaatgatactagaatttcataattttacagtattgcagtaaaaagatgtgtgtgaattgctgcatgaaccagtgtgataggaacaagattcaatagaagctcaaaacaatattattgattggaaaaactagagctgttacagaagataacccctgtaatcccagagcaaagttactcagag

SEQ ID NO: 6658 - DNA, 1200 bp, Glycine max
  Soy_ogl_1018 Gm03:41525301..41526500 Cluster 30
tgtgggcttgtagtttctaggcccactccatgcattcctttgcaagccatgacatagaagctaactcggaacgcaaacgcatcattggttactacttggcatgactcagctagccaccgtcgggggaattggaacgttttcaattctaattttaattcattttaatttggaaacgtgaaagctgaagcttcaagcttacgtactgtacggtgagcgattatgtatggtggcggtgacaacatgcaacttcgtggaactttcatactaaccaccactttgccagagagaatgtctcttttctcttatcagacaaatggacaaaattctacctagtcttggaataatggttgtgaaaatgtctcgtggattctttttaacgtggtacgtcgatgatagttggtggtgctttacggagttaaggtagaatatgtcaagtgcgcgttccggattacggagggttatctgcctattgtgattaaccaacaaaacttgtacctaatgcgacagtttcagtgacttatttgtgtacttgagttgagaatatagattattagagtgcttcttcttttttatgtaaacaaaatagtctatataaatgaaggataatttttaaacacacaagttagttatataaaattgagttaagctcaaatttaaattttaagttagtattagattttatccttatagttgattgttgttgttgagtctatcaagttactcatcttgatgatgttgttttatgagttaagtttaaatttagattttaaaagttttaaattaaacaaattaaatagttattatatgattatattcaagtttaacattagaacaaaatatgctttcgatctttttaaatttgattctatcccccaaaaaattgttctatttttgtcctgtaatttagaaatacttccattctagtcattaaagtgattacaactattaacttttagtaacgattataaccacgtatttaagatcaaataaaccaaagagcaagaatagattaagaagctagatgtgagattcataataaaccaaaggtgaatatgttgttatttatcaaacgacatggaatataaaagagttaattatttgatttgaagactaatttcctaacttttaagaaataaatttgaggttaaatcattatttagtcttcaaatttattttatagatttaatttggtggtttaag

SEQ ID NO: 6659 - DNA, 1000 bp, Glycine max
  Soy_ogl_2850 Gm08:41329401..41330400 Cluster 30
ttttttgcttctatcaatgtaaagaagtcagacagataattttaaccttcttttgaattgaagtgaataaaatattcatagtatttacaagcaacattttgaattcactaatttaagtttggctgaggacatttcagattcattgttctatattgcgatccaacgattcctaaatgttgcacttatacacaatttaagaggctgataaaacacaatcatgaaatgctcgaccgacattgacatgctttgcaacttcagaggaatgctcaaattattaatatactcatgactaaacgatttaaaaagataacaattaaattattcggcttggtgcatggtcaattaagtttaggcggctattgtctacaattaatctgtagtacaatctaatttaactaggttcattttcaagttcaatgccaatccttctctatcttcaattgattctagaaatccaaaaaagttcaatgtagcacttttttaaacaggaatttgatatatagacagggatacaatttctggttcaaacttagcgtgattgagcaattaaaccctttccagataagagtgtaaaagtttttgtagagcaagtactagtgtgcatctccaaagttagaataaccatctccaagggtagcaagtactactcagcatctcaaaggactttcaaaggctctggtaggaagttggtcatccctcttatcagattgagggttctgtacctttttcatggccacaacattttgaattttatgaccttcgctgttctcctgatgtcctgattgttaacaaacatgaacactaaataaaacaatgcatttaagaagaattcatgtggagcacaattatcttaggaattgttgcatgtaaaaaggaatagacaaaaaatgtgctagttagtgaaagaaactggatccagacacaggtaaatgtaatagtaaattttattgtgttaatatgttaaagcttcacaaataacatctatggggacttcatagct

SEQ ID NO: 6660 - DNA, 1000 bp, Glycine max
  Soy_ogl_5542 Gm17:6067801..6068800 Cluster 30
atataaataagtatcctactgaaatttctatggaaattaaaactcaacaccattgtatttataaggtaaacttgtaatctttgtcctttaatttcggttttagttctttattcaatttagtcttttaaattatttaggtcttagtctttattttggtgagattcggaaattggtcgagtttttttggtacaaaaacgtaggggtgccattgttagtagtgtttctactgaatggtgttttatatatttaaaagtttaccctctcattttcaaaaaaaaaaaaaggtttaacctcttattaattcattaaaaattacagaggggattttaaaatgggtggaagaacatatatatgggggttgaattaaaagttgactttaaactatggttgattcatcttctgacagctttaaattattcagtagtcagtacggcgtattaatttgtttttgttgtatgttctgcagttctggtctggaagattgcagaacagccatacacttggatactaatttcatcccttgtggtgaacacaagaatgatcgggaaaaagataatggaagttctaactcattgtatgttgggatattaggtgggaagtttaaaagtatttttacaagtaacaattttttttttattttatgctttagatattaagaatgtatatcaaattttttaaaaagtattttttttttagttttatctaatcataaccttaatttttgtttgttgcagcctgcagacatggaattatttatgttcaatttacagatcagcgaagtaacataaaaaaaaagggcctcaaaatttaaattcctcagtataataaatatgtagttgaaatatgtttttgataattgtaatatagttgattttaatttcactagttaaaccttattttttctttattttactatctaaactttttttgtttgatttaagtatatatcattagtcaggttatttgtttaatgatgaaatgataaattatcaaaggatca

SEQ ID NO: 6661 - DNA, 1221 bp, Glycine max
  Soy_ogl_5563 Gm17:7352701..7353921 Cluster 30
aggaatttatgtcaaggaaataaaagtaaagaaaataaataattcatatattttttgtatgataaatattattctaccataggaattattcaaacttttgaatttgaatattaagaatgtagttttttttttcagagaaaatattagtggtctagataaaaaataaataaaaatactatgtaaatatttttttttctttttatttttttaatattggcctgtgtaaggttaacaaaatcgttttaatgtctagttttcttcaactctacgacatggtcaaacatgaattaatgcatatgggtcctaatcacgtgcatgacatatttatatctgattatccatgacaaagcctgtactttcctacaggctacagctaatcttatttgtggtcacaacttcatgcaattgcttcttgaattagtcgctaatcatattatgatattgacgaaaaaaaatctgaggtttggcgtggaccaatcgcattatgcccaatataacgcgtttcctttctagatcacaattatttagcagaaaaaataataaagatctaagtactatatgacaaggaaaagtggaaaactgttggccatcgcaaatctgaattaaaacaataaagaaaactagaaagtcatcgtctctttggttgggacgtttgcaccatgaaaatgacaacgctttcaaccaaaattaataaaataattgattttccttttgatgcatcttctcaaaaccaaattaaaatagattggttcgtcaaaaaagcagcttctcttaatttgttaaaagactttattagtttatgtggatacacaaatggaaatttccccatatatgcagtttggttagaaatctttcttgctcttttcaaattagttgcactggtccactgggagagctgtcatataacgaatacatgcaattgcattatgcttaattggaaattggaaaataactaacgattattaagcagtgtcattgtcgtgtcatgcacaatatacgcgttgataataattattataagacgtttctccatgctttgttcttgggttgccacgacgacacgaaattggattattatttagaagaaacaagtaatatactacgtactagtatttcacagttggacactttgcagaacttttaaatttgtagattgatcacgatagctaccgtacgttcagacatatatgtatacacatgaaaatcatatttttcggagag

SEQ ID NO: 6662 - DNA, 1000 bp, Glycine max
  Soy_ogl_649 Gm02:44675801..44676800 Cluster 30
atataataataaaattttggcatataattgatggaggttatgtctcagccattaaatgtctatctcccagaggaatgaaaaatgccaaatagaattattatcaaatagcatataacaaagtatgacagtggatttggatcacctaacagtcaattgcatgtgcggtcagagaaagatagatacatggggtgattctatatttctatagttcttgacattataggccccacatattttttcttcttttctatctcaaaagtggatcacatataaatatatacatattttgaaatgtcaacagagaaccaacctagatgaattggaagataaagaaagacttttagaagtcttcttaggatttttgtgtctttatagtttggtaggttgtaaacatcatatcatactatgggtgcctaattcaggtttgccagaccttgttcttaatttgaaaggaaattgtcgctctaagtgaacttcaattggggaactctgcacagagtaatgaaaagaaagaaaaggctcaaacccctcaaagctctgtttggtggaaaacttagctattttctattattggatgtgatcataaggtcaatgaagaccaggcattcatctacttcaatgttcctagttaattgccatgatgccccacatggaaaatttgaagtcggtcatcaattaattacccctcccccctccctaccctaacacatcataattatatttccatttctcacttttcattatttcaattcaaaatctctaaaatgtttggaagttgggttttcgaggaaaaagacaagagtaaatatttcttttctaacaaatactttctaatttaacaaatttttaaaaatagaattgagaattgtaatttgtttaaatccaaataatatgtatagaaacacaatactttataatcacaaagtctaaaattattttccacttttgactaaaaaaagaaaatattttgagaaagataaaacaaattaatgaattttaa

SEQ ID NO: 6663 - DNA, 1032 bp, Glycine max
  Soy_ogl_6318 Gm19:1331601..1332632 Cluster 30
caacatatattttctggcatacaatataacattaaacacctcctaccattctcaatatctaataacacgtagcctcctagatattcatcttcacgagctgatcccatcaaacatccaccaatacaagccacatgactactcccccagtaaatgaatacattaaaagtaaataagaaatcataatactaaaagggggggagtcagggatacatttgctagtctttcccattcttatataataatcgatggtgctatgaacttgaattgcgaacaaaagattagtttggattaattaaaatttcaactaaaataaaaattcatttagtgcattgcaagttaaaaaaattatttataataattaagtccaaaaaataaaagattagttttgaataattcaaaattctaattattgacgaattgttcatttaaatcacattacaagtctctctctttcactctctctctcaatggaccacatgattttttagcctcaaaattagactaaacttaattgcaaacaaccctacactcaaaatattatattagaatataagtatgaaggtgagtctcaccttgagtataaatgagtaagttgaataggataattaagtagacttataatcttgatgtcttaagattttaggttaaatgttatatcaaatttacttgtgtggtgtttttaatgtagtgaaaatctcttaatgttttatttccattggttgcttcttttaattttattttatcggcaaaccatcaaacccatgctatatgtttaaaggaatcaagttactggctatttgtgttacaattgtgggtgtccgaattggtttttacttttaacaattatacattcatgcattatatattaatgtttttaatatcgttaggtactaatttaatattttaggacctatcgattatggttgaatcatcaattttttaaacaccataggccttgtccatgtactgatgtacatgacttccttgtgcaccgtttcaatgtgcaccttttagtataagtttatatccttc

SEQ ID NO: 6664 - DNA, 1048 bp, Glycine max
  Soy_ogl_1446 Gm04:46825653..46826700 Cluster 30
attcaattatggtggatccaacaacataaataccaacaatgacgcattcctgaaacacaataaattagtggtggatattttcaaaaatactactttgattgcaccaaaaccaaaaatggctcttgatcccacaattattattgatttcgttgccacaattaacgagccaatgaatgcctctggttccaattagcaattaaccccacaacaatccttacccaattcaacatcagtcaaatagctaaacaatgatgacatgcaaattgagaattttgattcacaagaaataacaactagagacaaaaaaatagaggttgagtggcaacaacaacactgacctaaacgaggtttttttcggccaaggcatagagtggtgcattgggaactgtaattctataaatctttggaactaacattggcttaaatcaaattctaccccttttgtttattctacatcatcattgggttttaagaacattaatgtggttgatctttttttttattccaaacacgcgtgggtggaggaaaattttaattgatcttattattactctctcggatgtagctcacatacaaaagcttcatcttttaaatatcataaaagtagataaattgacttggaaatttactccatcaaataattactttgtttgtacatcttaccactcaaatatggaggatgtttaggactctgaacatctatgtgtttaggtaattggttaagcatttggaaattgcatatccctccaaagataaaacattttctatgaaggatcctcaaatgatgtcttcccataaagaacaaccttctttcttatggtgtaatatgtcatgcaggttgtgctttatgtaatgataattttgaatctgaatgacataatttcgtagcttgtgacaatgctaaaaaacactggataattgttggactttaggatttcatggaacaaatcacccatcaatatggaggtatcaacgatatggtcttcaatgtgttgaacaagatgctacattaacaacaaaggatatttgctattacactttggtgtat

SEQ ID NO: 6665 - DNA, 1023 bp, Glycine max
  Soy_ogl_2520 Gm08:5242101..5243123 Cluster 30
agttttcatgaatggttcctatatattcctagttcctaccactaggaagtgttttcttatttatttattaatcgtgtaaatgacacgttttattaattaattctttaacatagataacaatactaattaagtatgtagattgcaactccctcaagcaattttacaaagcttcttcctccacgtttctaaatctcctcaagagcattatcataatactatttgaagcatctgcacaagaatttgcataatgattagttatactgttaactgtatttcactttacatgtaactagataataacttttccttttgaatttgctcttgttctgctacattcatgctaatgctgctattaggttgcgtatacctcaacctgaggtaacccacactaaaatatagttgtaatgctgtatatgtcagaactctttaataagaaacatctatattggttgggatcaataatgaaatgtgtacagaaaatgaatgagacagtttattgttattgaattatatatatttttcttttgatacatcttgctggaatgtcttagtgtgagctactgcaaaacatacagtgtcaaatgtcaataagattgttgcattaatttatatttccatttgataaagaaaaagattttaattttaatctgtttatagtcttatatatagagagaaaacaatttaacacgtgtttaaagccaattcccatccttggtttagaaacatggcttccatatattaaacatccattaattgaattctgctgaaattctcgggtgtactagggaatgcattcataataatgattaattgattatgtgctaattttgttttcttttagtctcgaagggttttgactgtagccgaagcattgtccagcattcatagaaatgagagagaatgtcggagcgtaagatgtaccctgaatgactagaacagagaagtgatattagagacaaatgacaaattggtgttgggaatatatatgtacgaggaagattcaattgattatgttattaatat

SEQ ID NO: 6666 - DNA, 1000 bp, Glycine max
  Soy_ogl_6317 Gm19:1317301..1318300 Cluster 30
tttttggcatttgttgatatcacgacaaattacgaacatatacgatcgatgtcgttccaattatggttgcgttacagttgcagttgtttaaaaaactttaacgttgtggtctaaatcacggtcgcaaacccttttttaaaaccttaggtggccggtggtttggtgtgcaatagtctggtgtatttgtaagcttaggaatgcctatctgttcagaggtcttgggttggatatccaatcacataaaacaggatattttgttcttcagttagttggtgttggatgaaatcctctggtttgaagtttaataattctgtttcatctaacctatgatggggtggccatacgtggtgcagtattattaatagtttgctgggacggtgggttttatctaatactctttgtcttatttttgtagctaaggaacctacctagcttagtaacttttatattctaagtcttacaggtagaaagtgctctctcctggattcatgaatgtaacatgcagcgtgttatagtagagctcgattgcaaatatgtagttgcttagatagtaatagttccaatttattcacaaatccaaacaattgctttttcaccttccaaacttcagtgcattttattcggcaacaagttaattaatcaagttgttcattctcttataaatgcatctagatattatttaatttgctagtcaccatatctttgaccatgatgttattcgttgtattgaaatattttacattaatgaaatgatataagtctttcttttaaaaaaaagttacattacaacaaaatagtattacaaaagtcatcataaaggtaaaggatatggttctccatattctatattgcaaatctacttaatataaaaatgaatttggattaatcatataagatataagattgattgaatgattaaaaaaaagttgctttcaattccttatcttatcatcaagaactgggaaagtttcacaatcacattctattacacattgcaatg

SEQ ID NO: 6667 - DNA, 1100 bp, Glycine max
  Soy_ogl_3675 Gm11:1333901..1335000 Cluster 30
tctgaaaaatttcacgaaaaaacctaaccaatagaatcaacaattgttaacagatctgaagaaattcatgaaaacctcaaaatgcgctcatctcgcagatctaagaatagcgagaatttttgcaagcacgcattgactattgcagtaacgtttttgacagagcttccttttcacgcctaaaccaccattagcatttgccattgaaggacgaaaaggggcgtcacggaatgaaatggtggccggcattgtgatatcttcgacgaaaaactcagatcccacgaaaaaaaaaaactagatatgggcttccgatgtgcacgatgttgtcactcgccgcaacaacagtatcggaatatggttaagatcctcaccagaaagagataggggtagaacaataaaggaccaagtggtactatgcgcatatatataaaaatggtttttttttttaaataaacacaattatacaccatgttgcattgatattaattttttatgttaaaaaacattcaaactgaaaattaagaaacatctatttggtgctattctcctacagtccccgagccatcactaacaaacaaacccagcttaagcaatttgttcttttttaatttcaaaatacttcaaagttatatttggtttaataaaatagaaaatataataaaattttattaattaccattatttgtattgatataaaaaggaataaaaatttgtagaatttctcacattttattcaataactatatttaatccttataaatgatagataaattaatgaaaatgtttcccaagatataattatgatggtttaaatacataaaagcatcgatagttatttataataaaaaagtacatacaaatacatattcatcaaagacaagtattatcatatagttatatttattgagcttaatacttgtttacggaagaaaataactgatagtagaatcaagtctaaagtctaaactttacaaaccaagcgtatcaatccttggtattccaaatcccattaaaaaaccgagcctagctaaacgttagagcctagctttgtaaaattttctgtcaataaaatatagaaattataataacattaaagtctcgac

SEQ ID NO: 6668 - DNA, 1021 bp, Glycine max
  Soy_ogl_3764 Gm11:6024601..6025621 Cluster 30
aaggtgtttatttatccatctgaaatcgatcttaagagttttgactacgttgacagtaaagatgaaatgatttttttttatctatatattaaacgatgcttgtagttgttggtccaaaaaaattattaaatgatgctaagtacctatattctataaaactgagtgacaaagttaccagttgaagttatacacaagccccacggttgaaatacattttactgctttatctcccttcccattaatcaagatgttaaaacacaagtgactatgagagtttgaccaattactacaatttctcattttcagaagaccgacagagtcattttaaatagtaacaaactaattgttctatcgtattaatagtccaataataacgtcctcctcttgcatacattgaacaatacctttcttccttatatttaccctcccgtaagtttatgttagtatttaatgaattctgaaattaagtaaaattggtattttgataattcgcatactaaagatttatgttaaagattgttgaagtaaaactctaattctgattagagaacaataacagtgaaattgcgtttgtaagttttatctttttattttgccagtgagaagtgggctaatcaaaacggtttctgtgtactcatgtatgtctgcaatgtcgatcaggtcaatgtgtttagtcctaaaatactgaaattgtgtcgataattttttctctttctatattaaaaaccttccgtagatagagttagaggcgcttattcataaaatgacttacgtttccgtgtcatgaaccagaattcattattggtgctaaacagctaattaacatgcctttgcgcattattaataatttgcaatacatgtgtatatacgtatttgtttataccttctttggacgaagaagtggagatcgactaatggatattcatacacatttctgttttggatgttgttccgtctttaattaggaacatgctgtttagaggaaggatcaaaagtgaaagaacataagaaccaaattatg

SEQ ID NO: 6669 - DNA, 1054 bp, Glycine max
  Soy_ogl_3820 Gm11:10193847..10194900 Cluster 30
tcaaattgattactactatttaagtttaaaataccatatttatcatgattactaccatttaatttagttaattatatggacgtttgtcactcggtcaaaattaattttgtctgtataaaaaactgacaaaacgattaatttagtttaacataaatgctttaacagaccatatgcaaaataaaactttctaagtttaaaagaaaattgaaactgaaaaataaaatgaaagaacaaattaatcgtattttattttgtttaagtataggttttctcggtcaagatacgaggccacatatccaaagcattcgagtatgcattatctgcattggacattctaggccaaccttaggttatatatgcttgtcacacctataaaaaattgtgaattcttcaaaggtatttttctttataatatgagagtatgatccaaatctttgatcttcgcaatccatacatggattaatatggtaatggtaaaggaagttgattaggcacctctaacgatcaatagaaaccacatcttcagatggtgtgatgaggtcgagtcaaaaactaacctcaaagagcacacaattccttaatcttaaacacacaggacaaagagattcccatgtgatgttggatcaaaagctgacttcagatgacatacaacccctcatcattaagtacatagggcaatgaggctcctaagtcaaaggttgacttaaaagtaaaccaagtaaaactaaagttttaagttcctgaataaaaaatattttatattaatttaaataaaaaatatcacattataaaccaagagacccaatatatataagtataacccctcaagttttaacacaaaggacaaagagagtctcaagtgataagatcaaataagaataagaataagaaaccaaccccaaaaagcacataatcccacaaccttcagcacacatgcaggctaaagagactcccaagtgatcatgagtccaagattggaaacaaagggcacatatccactaaaaactagaatcattttatctctgggagatactttgattccatactcggtctg

SEQ ID NO: 6670 - DNA, 1485 bp, Glycine max
  Soy_ogl_4605 Gm14:18872..1888990 Cluster 30
ctttttttagaaaatggaatttaatatcactccaccaatgatttattagaaaacgaattcagtatcactcaaccattgctctacatttatgcttaaacgagaaagtagttggatgaggggttttttgttccaatttttattgatgagctccatccataatttaaaaccaatatgttagcctagattaattaaaatattatcactcaataacaataatcatcatactcaataagttggatcaggcgtgccaaattgattagaaatgaattgactcgcttatcctatattttatataacattacttattaaaaaaacaaaaaattaaaattagtactgctgataaaaaaatttagactaataatgcataaccataaactattgtgtttttttttttaatttcaccatctcaattaactttaatttaatcttatattctgttttctttaatatatattaaatataaatcaaaactcttttttctttcattctaattatatatagcgccacctcgtagttttatgcatcggtatgacagaacagctatatatatatatatatgctgaaatttaacttaatgttacagcccaaccattcattattggtcatgactggcttcctgtaacaagcaaatataattaatgctaaataccagtacgacttctagaaatgataaatgacgaaacaataataattcattttaattagtattataaaaacaaaaattcgaaatagctcatacccaatgaatccaccagaaatgttgaactcgaagtagtagtttaataatttggttcaaaagaagaagcatgatagtactcagtagagtccaaaatggaatgctgcatttgtagtactaccaagttaagctagctggcatagcagtgtagtggcagtcaacttcatgcactctctctcgataacaaagacactttatttagattactgcacgtaggaatgaataggaaatatcaatctccaattcaacaatgcagccaaggtcacaacattaagtagattagggctgcccataattttttttaaatcgaatcaaatcactctactaaaatgatttattttgaacaaaactgttttcatcataaagtagctagtttaacatttaaattgatttttttaaacttggttcggtgtttaattagtttagttttttcttttcctcacacatatatcattaagcttttttaaagaactaaactaaatgaattactttataaaaatagttttggttcaaacttatagatcatttttataaagtgattcatattcaattcttctcaaaattataatttggaatggtcgagttagaattgatattcttttcacaatcctattcctatcactcacagagtacgtgagacctcattgagctttaaacattcagtagcctctttcttttgtattttattccttaaattaaaacgcgttctattctatctattttctgcccccacacaccatgtagttctc

SEQ ID NO: 6671 - DNA, 1062 bp, Glycine max
  Soy_ogl_5501 Gm17:4112139..4113200 Cluster 30
gatatactaacctcatcaaatatagacacttatataagcttaaatttagcttacttgattgagtaatgttagttattataaattttttaattcttaagttcaattttgtatacataaaatgcatatataactttgcataaatggtaaaaatttacgcttatttttattgactagacactagaacttgtacatatagagacaaaaagaaaccgatcatccaagtagatcacctatgttttaacaaaaaaataacaaaagtctatatagagagaggagagtgggtaataatttctcatagggagagggataagattgttctaagaataatttttttaacgtttattctccttaatatttttatttataaaaacatgaaatttacaaatacaacctttaaaacatgtaatatcatttgacgataatgcatgtaaaattttagctaaatatttgttaaatgatatttaatctttgaattcaactttacatttagtcaaattaaacaaataaagtgagcatcaaagccttttaggtagggcaatattcaggcacaaataaagtctttttcaactagagataaaataaggggaaaaagacgtagccaggggagggacaggagaaaaaataaaagaaaaaaccagaaagaacaaggtcccgcacagataaataaatcgaaaccgaatgatctacattatatttgctaacacagcagttattgggctcacctattacccctactcttagccaaacatttgctttcaaataaaagcaacactaataacataaaggtgaagattatgagatacagactaatcaatgtttgctcaagaggaaagaaagtgagatcaatatggcatttgagtaatacaattttttttttaagtgtgtggtaaggaatttaatctttacgtttgtatatgaaaaatatttattaaaaaatattaaaaccccttaactcttacttgagggatacccttggattatctcaaaaaaaaaaaagtgacataagaaaaacacaaacaaaaagatttgatgaagggttcatttgataggatggaaagaaat

SEQ ID NO: 6672 - DNA, 1000 bp, Glycine max
  Soy_ogl_43 Gm01:2030001..2031000 Cluster 30
cattacagatagtttttatttttaacatgaggaggaacttaaatcactaatttttataaaattaaggatcaaattgattaaagttgaaattcaaagaataaaattaagttttaccgcaattatgaacacatattttaccctaaaattaaatatcacacctttaaagtttaatacttattactaaaaattttatgtcccctaataaaactagtatgttaacatcagagaaataagacatggtatgattgacataaatgcatacctaatggaaaatttgttttctcatttgttgtatttcatggttgctttatcaaaaccaatggttggaaattgtttcgcgtaatcctcaacttcatggcgaagctttgccatctctgactcaaagtaagaagaagactgaattgtggccaagatgctgttcgttgaatgagtatattccccttcaatcccttgtctctgcacccaaatcaataaaaaacgagctaaacaattagttgattgttgaagttaaatatttttaagcaatcgacaatccctttgttgtcttttttttataattatttgattaattacttagctagtgacctctttaagaagactaaaattaaaatttatttttatggtcaaactaaaattagaatgaaattttatgtttcctaaaactaacagaataaaaagaagaaaaaaattagcacatagcccagtcaagatgggctaaacccatgatcagagagatatgcactcaaacgggcatttacccggaaaatggatacagagcgtaagagcacaaaatagagaaatttttttaaaaaaatcgctagaaggagggcttgaacctccgaccttgtggttaacagccacacgctctaaccaactgagctattccagcttacaagaaaattgtctatttttattataataacaaatacttagtacataaacatagaagtcctagctactttttcccttcttgatctccatgcaatatttattggacaca

SEQ ID NO: 6673 - DNA, 1000 bp, Glycine max
  Soy_ogl_750 Gm02:49761201..49762200 Cluster 30
tatacatgcagacagaagaagtgctgcatctatctggcaagagtccctctacttccgtggttgaaaaagtgacatgcttgtggttgtggctgttgcttgtagaaatggacttgttttgtctgacttgcaagttccaacctcaaagcaatgccttaaaacggcattagtttccatcacattccagttgcataattaacgtgacttgaatattgccaacttgttatagccagtttggaattggaaccacgttaaccaaaagtaagagtaaagatggtggatttacattttctaattccatgttagaactagggtccaaacacgctaatttataagaaacagctggttacacatgtatataaaataatttgcttaatgagaagtgagggaaaggaaagaattacagtgattgtatatatacaatcagaagttcatactggacatgaacaatttttggttgtgatcatgttacatatacttttctatcaatatttttttaatttgttcataaaaattgaaaatattattaaaaaatttataataattcatgtacttgttcaattaacttaagttaaattactttaatctcgtctaatcagatttgaaataaatatactcattactatggaaattagcaaaaattatatctatatatatatatagatatattctgttttagaagtccaaatacgtatgcgagtaataaattaaatagataaaattatgtgaaaaactgttgtatttggtaaagagaaaggaaatagagggagtataaataagtaaataaaaaaagaaaaaaggaaaatagataagattttttttaattagccaaaaacagaaatagataagatataaagtgacaaaataatagttgttttgtttgagagaaatagaagggaaattgaatgaaaataagatctaaacacactttatgttgaatacataattgattatgttggagatcgaacaccagagcttgtgaggaagaaaacaccaacaacac

SEQ ID NO: 6674 - DNA, 1126 bp, Glycine max
  Soy_ogl_1052 Gm03:42824901..42826026 Cluster 30
gactcaatagaagaccgcgtgtcttgttgattttcatgtctattatcaccgcaattatgtatgccaattctaacatgaatattgacaaaaatgatattggaccgtaatggccgagtgacattggggaatagaccagataaactacttttgtcttttgtatttgttcacatgatgaattgatgttcaaagttacgaaagttaaatcatgatcactgagaaaatctaaattgatcaagtgaaatctcattaattagatttagagggcaacttcattaacttttatttaatacatgactattctctgtggctattactcaagaatttatataagtttaaggttttaaaaaatgattcgggatcgtgttttcaacaacatcaaagttttgagtggagactgcaatgccatcacaattgtagtaataccaaccgtatttaggtcctgtttgaaagattttatcaacaccttatgtttacttattttttaatgtaaatacttatagagtgtttggaaaaacttttataaatatcttataaattatccataagatcttttatgcttatttcatacgggtttagtgaacctttcaaacaaagtcagcccagggtaaggttattaaagtaagctttagacctatcaataaaaaatatttattattagtttttataaaacagaaaaaaaacacattagttgtttttagttttgaaatatgtttatagacgattggtgtcttacaaacggcaaatcaaatacacaggaagtcttttattttactaaaagtagcacaaaaaacagaaattcaaaattctgttcggcaacttcacaagtcattctaatcatctgtttgtctgtcttactgagaaagttgaattactcatcaatcataaggtgaaaatggggggctattttgcctcgaagattgctaagaatgccctaactattgctcacatttttattgttttacagatgactaccttatttgtcaaagctaaaactactctaacttgtttggttttcctggtgctggatgatatctgtactgcattatctagccaaagtgaatatggatatatctagatttttagcatgtagaaataagcctagcgtaaagcgacaaaagtttactga

SEQ ID NO: 6675 - DNA, 1000 bp, Glycine max
  Soy_ogl_1211 Gm04:4040601..4041600 Cluster 30
acgcagcactccatctcccaactcgagtaacctttcctaaaaaattcagaaaacgttgtcgattttcgatggaatcgagaaattaaccactgtccattttgtctcgtttttcatttataaacttgcttaccaataggaattaacgttaatttgtcgcctacttgtcccctctcttagcctagttattcattacttcttacttaaaatttaaacaaccacattgcaaatggtgcatccttgaccacatcttgtctcttccaactcttagatttccacatgagtggatattatcaaacattattttatttttgttcctcgaatacaatacaataaagaaacaccaagtggcaccaagtggatagactataagattcgtctctgggataagctccgccttgtcagcatcgccatccacgtcccgtatctaatctagcttcagataaatcctagtgcatttattaatatataagcaattggtgttagtgataagtcatgaggcttccataatattctattattatttctttattatctctgatataattatttgaacaaccatactttgacacattttgcacggctaactccaaacgagtaagctcaactctcaaattagtagtgatgagtttgaatgagtatatagtttgtgattttatataataaactacttacgtttttcttaataaaaaatcaaattcttgaatctagccaactaattaatgtattttataaattttctcctaatttaaagtttttattaatgacatgaagatattgataaaataatattattttattaagcagtttagttttaatgaattatcaatgtaaatgtattcatgctatcgattaataacagttttggtgatgacttttaaaataattatataaatttcaataacttttaatatataacaattaaggatttattgatagtatatttttctctactaaattaaaaaataatttaataaaaattatttcaacaaaaattagtttc

SEQ ID NO: 6676 - DNA, 1048 bp, Glycine max
  Soy_ogl_1712 Gm05:37645553..37646600 Cluster 30
tatatattgtatctattattttatgttattttaacaaattagaaagaagtagattaggattaaaaagagagaaaattaagtaaattttatctaataaaaaatggaaaatatttaatgttcattaagcacacatgtgagaaagagaaaaaaacccttccatgttgaggctcatgtagattccaaaatacgtatgtctgaatcacgtcgagtcctccttcttttgctttagctatcaaagctggccacatctgcaaataaaagggttttgtcaaaattcctcatcatagtcctctctttgtttttctctgccgttcttttctggctattcatgcaaaaaaaacccatccatagtaccatgcttattatatcttaattcaaacaatcaaaccttccaacctgggtttctacattgtctttggtacaccaaattgaaagataatttaggttactatttcttaaaaatccattgtgttgattcagtgcattttgtttaagcattagaacttccgttgagaatagcaaacctaggatgagaatagcaactccctagtggttttcagcataatatgggccattcaatcttcaataggtgctagcccgttaactatgatgagtcccagcccagttgaagctttgtccattatattttttgtcgtttagtgaacaaggcagaaagtaagctggagtcgaagttggtagcttctagctagtgcgaaggatgaagaagcttcatagaaggtgccaaacttactagacaacaaaatgttcatatccctttggacctgttgactctttctacatccaagtaggtttacgattgacaaagatgtttcttaaccatgttcattaaaccagtatatctttgtttaattttaagcaaatagtttattgaatttggaccactaaatagacggcggcgagcatgtatcatgattatgttgtatggagcaaaaggagctagaaaacttagtgctcaagtatacacgtagatgccatttcataatactgtgacgaaattaaggaaaatttcaaggaccaaaagctgcag

SEQ ID NO: 6677 - DNA, 1391 bp, Glycine max
  Soy_ogl_4893 Gm15:3626374..3627764 Cluster 30
cttacgtttgttctccttgccacctgctgcttgtatatatgtcccttttgtgggaagattttgcaggggtgactcaccaccctagagctagatctgtatgtaatcgtttggttctttgttatgaaaaaaaaaatgctgtgctttagtgtgtgtaccatgtacgtgtcttataatcaaataaaaggattagtcaacaatgttagattcctactaaaaatattttttttcgagtaatgcatttcattatttgaaacattattttaatatttcttatttacttttatctcttttttactatcatatcataaagtttattacttatatttttgtctctttttttctatcctggtgacaaaataacacattgagtgctcatgtaactttttttatatttttaaatacattgatatgttgaataaaaaagtttatagatctagaaggtcttgcacgaaaggtagaaaggtagctagtgctttaaatattgtagttctataaagtgaatattactctttcatttcaaaataagttactttaaagtcttttcacaatgattaattatgaaaaacagtaaacaacttaacgagtgaaaccatttttttaaattatttttattgattgctgaaaaattgattcatatggtattcataaaccatcatgttttgattgatatagttggaataaaaaaaaaaatcattaaaaacttaaaaagacgtaatatttattcgtactgttttgacgaaaaaattaattgtaccaaacaacattttccatctttaaaaacaaacttaacaactgacatatgacacatgaatactcccgagttgcaaaaacttcttgttgaaaactctttttaagctaaaactataagaagaatgtttggagtccggacaaacaactctattgagttagatgaataaaacaatataagagatatacaaaagagaaatatgctagagatttatatattgtccgtctcatccaaatgtgaaggattagactacataattttaaaaactgagagaaaaataaaatagggcaatcattccaaaaaccattcccactaaaacaagattaaaaaattgattctagaaggattattaagttgacttattttttctgatatatcaattatttagttgtaaataatatatgtaatgcatattatctgatttggtagctagtgagtagtgatagatacatatttttgttttttctcagaagtcacactaatattaaactaagtagttgtacaaaaatgtaatcgttacttttagtcgcaattcaaaaacttcatgcaataccttaagcaatttgcaaggatttgcgtagatcttttgcgaatgtcttttttttttctttggcaactttagtcctatgtttggtagagaggg

SEQ ID NO: 6678 - DNA, 1564 bp, Glycine max
  Soy_ogl_5852 Gm18:888501..890064 Cluster 30
attttaacattgactttattgaccacaatctaaacagcgaagatgcagggattgtgaactgggtggagcatggccgtccaagaaagtaagatgcaacacacctttgtttttttaatactattattgaatgttgattgttacatgcatcatcattatattggttattgggtttcttaaatgccaaatagactaagcacccagcaatatgaagacaaatgacttctagtgttagctgcaacaatacaacagtagttaataaagctctcttgtgatgatatcttgatatcagagaggaaaaatagttgttgcaaggaatcttataatggcaatttatatcctggttcccatgctcacctcctgcagtattgtcatgtgattcgatgggagctttagttttctggcaactcaatctataatctcctcagattaaaaataaatatgtataattgggacacattcaactccttttcttccaattcgaaacaaaaataagcacaactcagtttacaattggactgaactgaaaatcaaataagggcctttttcagctttactttttgaatgtaccttggggtttcccaattaaaagccaaacatgcccttcattatctggtcacattgattttggacatgaaacagtttccttttctggtctgagaaactaattccatgaactggttgaagaacataatctaataaaaagttattttcctgaagctgacccaaatctagttggcacaaacgtcacgtgctacttgcttctgtaaatggaaagcctgagaaaataagaaagttggagatcttataagcctagttatcaaaatcatgttagacacaatgttatgaaaagggccgaaggcccaataaagcaagcaaactaaccttaggcccaaacccaaacggtaaagatctcaatatgatcgccagtgacaattttttttgtggctcaaatacgtctctgtgattttacttcctatctaattttgattcttaattcatgtaaatttatatttttccaattttaacctttataaacacaaacttatggaaactataaataaaaaaaattatctcgtcagcctaccatgtaattagccaaaaatataaaagattgaacttcggctcatataatttgaaaaattaattaattagatttttaattcattaactcagccaccaccttagtcgctgaacttgggttacccaattgagtcagtgattaaatatcctcataaaatgcattaactatacttgcctatctatcttagaaatcattaatttaacactatttgtacagttaaagcacttttgctttgtttttaattgaattgtacaaacagcagagagacagaagaatacaggagctagattaattagaattttacagtggaaagataacagagtgaaatctatgcttatggcaacacgtacgtgaagattgcgaaacgatttgccacagtgacccgacagacatggtaaaaatgatatgttggtcccaaggatcattgagactcgagacttgaaagttgaaatcaactcttctcctttctatctcaaatacaag

SEQ ID NO: 6679 - DNA, 1055 bp, Glycine max
  Soy_ogl_2455 Gm08:1688818..1689872 Cluster 30
gctgtaaaattatatataaatataatttctcaaataatatgttgatggtgcgtggagaatggtcacccttgtattgtgttgtcttctatgttctccaacattgtacttgaactttagactcaggctaccgtggtcaaagaatgaaatttgtgtttcatgcacaaaattttcctcttttataatataatattcaatgagtagattcatttcgtctaagttattgtagtagttaaataatattttaaagataaatgtattatgacttttgtatccctttttttaaaatgaaaattattaatgttgatgtgttttacccatttgtcctatcattaatgggtatattcaagagtgtttggtactttttttatttcctttttgtcgatggcggaaggcaaacattgttgctataacagattaaatcctccatttttgttaattcgaatgtaatgcccattgtcggaggttaatgtttggcagaggtgaggttgtttatcaagcctaaaggttgcgtgatatttagcatcctatgtattcgatgaagacggtttaatgacagaatttgtttaatacatttttaatgggcaaaaaagacattaatgttgtcggaggacaataatgtcttattatctcatcaacttcgtctttgtctattattattataaaaaataaaaaaacagacaaacttacaataccaagttagatttctttgtgcaccaaacacataatttacttgttcactggagtacgcgcttgaactttatacaatgagttcaacacgagttgttaatattaattcataatttttttatcgataggaattaaaaataatattaaatttataacatttatgtatcatcctgactcaattaagctaaacattttttataatattaatccatatattttatgcatctacacaccgaccacacaatataccagaaaatctggcatcttcctatttctaattagagtaatttaatcgccaactataaatagtttaatagttatgtataactagctagtttaaaagtttaatcaataaaaaattattgctg

SEQ ID NO: 6680 - DNA, 1000 bp, Glycine max
  Soy_ogl_3305 Gm10:1749401..1750400 Cluster 30
gcagacgctggagaaactgatctctttcttttctaattaacaacccaaaccctaaacatgaatttaaaataaaagtgtatatattttacttccattacgcacatatatatcccggcataactgttctctttcttttcttttatcttttccttactcaactcttcatatattaagaaaataataatatattctactttgttacctcatacatgcatgatataaaaatctcgattaatttcaattgttacacaagaatacattaattgatttaactttggcaaaaaggagacatcatccatctgtggagtagtattgtgagagggtatggggatgaattaattagttctttttaagaaatgaaaaaataaagactaataagcggtacaagaaaaaaaatgtaccattttattaacaatattctagttgttataaaataaagtgaaagtgtgtatgtgaagtgtgattattatggcctggatgcctttgtacttagggccaaagagaaagatttttcgtgtaactgaacctctcggcgtgagatcactgttgcggaacacggtgcgtggtcctgttaacgtccttcatatatcttaaattaacagtagcaaagttgcatttatatgcagggaagaatataaataatattaagatgcagacaaatcccaaaaacatacttatggccctcacttgtgtggatcaatggatgtaaattaaaagcataaattgccatgtcctaagaaagatttttctctaacatctttgtttaaagagagcatcgatccaccgggttgaaaattaattcaatttataggttatgtcagtgcttttaatttgacacaactggaatgtcttcaagttatgaaggcttttgttggttcaaatatgtgcctacacacattgttccttctgtacgtagtcttatatatgcacaagtttgtagttactagttactgtaatttttctttccagtgattttgctgcataaagattataattaatt

SEQ ID NO: 6681 - DNA, 1286 bp, Glycine max
  Soy_ogl_1510 Gm05:1270101..1271386 Cluster 30
gccatggatgaggaaagttgaatttgattcaagagtttttgggattcagtaacgagaatgagggcggcgctagagattaggtttggaatgagagatcagtaccaaacttattgataccatattgaataacaataatagagaatatttggcttctttatttcatagtctcaagtgtgtatatatacaatagttttgaatcaatttgattctacagaatcaatgctatttaattcacagaatcaatgctatttaattcacataaagctattactaaaaatataatagacaaggaatattacaaagaatattttatattctaataacctgcaaggactcaaatacaatatctaaatcaatgtccatgaggcgatcaaaagtaaaatggaatgaaattaagtgaccttaggtttcccgtgtaagtcttatatatggttggtcataattccctacgtgttacataattattaattgcatcacattattaattaagttgggatcataaatacatgatgatcttaaactacataatatagggacctacgattctaggatgctcgttagaatatatttatgaatagtatctggtgtggcacaggtgtattaatattagttatgttgcacagcttcgtggaatgatgctcgattaattagggtttggactgggttgatttcgttatttatgcgtgggccaacagaggcgaatttaccataattagagggttttggggaagctgccccacaagatttttattttttcttgatataaaaggaatgtatatagagttataaattgtcttcacaatttaaaatatagttaaaaaaataatttataataagtattgtacccaaaaatttataaatgtgagaattaattacctccagaacttaaaacttttggatccgtcattacaagccagcagcatgtttgctttgtgaatttgaccccaagtccccaacatagatatgtcagtcgaaaacaagctcaacatgtcagtgaagaatataggttactcctcttatgctctagtagttaacctactcctctcctgctttgctgctgttttcaagtccctcaatgattccatgtttgaaattaatgattcaaaaagtgtatcggagaatagatcgaaaaaatcaagatatgccggattgtatggtgaaagatggaaggcttaattacaatttttggaacgtacaaatatagtattgatctaatatgtctttttatctaattagttaaaaaaaacatttattttccttcataatttttataaatcttctgaaaa

SEQ ID NO: 6682 - DNA, 1100 bp, Glycine max
  Soy_ogl_1657 Gm05:32210101..32211200 Cluster 30
taaaagctagccatatagcatgtgaatatgatttgaactttgagcacttgagaagagataatgtggagaagagctaattgtcagacaatttattattgtcgtttcagacaccattagctagcaaacacattgtgcaaaaccatctttttgagtgccacagaagagtgaaattaaaggagtgcacaagcaagtggtcaagtgctacttctaataatctaattaccagtttctgtgaatcatgtataaaaatatcagtgatgggattaggcacacttatcaaatacaccccaactcggctctaaaatctaaggaacggacttattaacagatcgacgatcaatacgtaacttcaaaatagttttaaagtaattgtttggaagcttatggattttgctgtcacacctatatctttgtgcatggaatcattaagattagaaaactaaatagacatacaaattatataattaatgagtatctcttaaaccataggtgttaatgttcatcttgttgaccttgacttacaattaatcttatgtaaaatatgcatgatatataaaaaaagaataatgttatatttgcaatttattttttcatttttataaatctctttctactatatcatttatgatttattttttctcttctttacctatctttttcttttgctctaaaatactatgttactagtataaatttttttttattgtatttgtatcaattttagagtagtagtactattatatatatagaagaagaaaaaaaaaacaattgaagttaacaactgtcttatagctagctaaacccagactttgtctgctggtgctaattttgttgaccattattttcggaattttgtttgataacttccctaataacctatgcatgctcggagaaagtagctgacctgcacatggctgcttacatttcaagaaacagcatctcttcatcgcactttctcacactttcgttttaaaataattactaatacttaacactcgttccgttccaaaatatataatgttatagatttttacacaaaaaaatataattaatttatttgaattttaaagaaaaattagataattttcaaatatatcttt

SEQ ID NO: 6683 - DNA, 1402 bp, Glycine max
  Soy_ogl_2563 Gm08:8494699..8496100 Cluster 30
cgaacagcagtcaacagcaatgaatgcatttgagttaatttctatgtccaaagggctgaaccttgaaaacttgtttgatacagagcaggtatcaagctgatatcattgaattggggaggaaaataacaaatgacagggacttgtttcatttagtgaactaaatgaaaaagtcaatttgatgaaaaaggtaaacaagttttattaagtggagttgtttctccttaccccctctaccaaacacaccattaaataaagtttcttcatctataaaatttcttatttaaataaagtacttaaaattatatttttataaatttctttattctggaacacattctgatttcttgattttcttattggttgcaatgtgaatagaatagtttttaagtgttatattttctttgattttccaatcagtttttaagtgtttgatcaattgctttggcacttggctgaattcaggtgcttatgggcagagagcagttctcaagtttgctcagtacattggtgcttatgccattgctggaaggcatacccttgatactttcaacaattagcttcaaacttccttcagtgagcatcgccttctcatcctcatcgatccaagaacagatcaccaggttaaaaggaaacgagtttgactttagccacatttgatttggctttcttgcatatttcgacctctctttttgaatattaaaaaaatgatactggagtatattaattctctgttctagaaaattggttatgacaagacagtagtagtttccaaatattacatgatgtcaaatgttagatttagacccctatactaatttaccttgtgttttacttttaattcaccttgcagtcaccattacttatcacatccttgaaaccagtcagtttcaagatttagacaacctacaaagagggaactactcttaaggaaatacaagtacgtttaatttctttattctggaacacattctgacatgcttacaagtatgtttacaattatgaagtttcttcccgttactagcttgcttttagtgagtgatacttatgtatggatcttgaaacatgtagatgagatgcttcagaggatcatcccccaacttgatttgtttatgaacacagtggagggtagagataaactttaaggtggagctactgaaatctaaggtaaaagctttactaattttaccttagacaataatgcaattttcactcttcataatattttgcttttgtatttctgaatcataaaaagctttctctggattgtccactctaaggatcaaagtaagaataaggttaaccatttcttttattcattcctttaattttctgtgtactgcaattcctcaaccaactcttctattttctgagtgtttagctgtgttgtagtaaagatattgcc

SEQ ID NO: 6684 - DNA, 1022 bp, Glycine max
  Soy_ogl_2900 Gm09:353514..354535 Cluster 30
cacacgctagctcttccaatctgtgaaaagagagttttttagtggcatgaattgggacatctcattatcctcctcctcctttttttcattgatcataagttggctatataagcaaagataatgattataattctttgactaattattgcgattatcattgaaatattaaagcttccaagtggtaaatatacggtggtaaagttggtaaccgaaagtcacttttatgagatcaaataaggaatagatttggctatggtgaaagaccgaaaggattatttgaaacttatgctgtattttctttgggtatcttagaaggcacatgtcctacatttttcgagtgtttttatatcaactagtccgatattcaatagtatcctatgcttatcagcctcatgatcgttctagctgatactgtgaccaacagttgctaatgttttgttgctgacacacaacagggtgacatgagtcttctccatgtaaacatagtctcctataaatttaagtgtcatcaagcaaatagcatattttacatttttacaatgctttataaaaaacttattttatagtaactactgaaaaatgtatattttagagaactttttcaaaagcatacacctcagatgtgttcaactggtaaatgttcaaatgctttatggtcataaagttcggtttctttggggaggaattgtgtgaacaagtggttcaattagctaactattgtgtattatacaaagcaagaaaagcttttggatgcatcaatgaacaagcaacgtccctgcacaaaccaggctgtcctgttgaaatttaattaagaatcatctttagtcacaaacataacataattggttaaaagaaagtaaagccattgtcttccaccatagaactgtaaacgcttcatacaatgccaccagtttctttatttatcacttctcctttttgtccaaatccccaaaattttgacaatggaagtcaaattccttcaccaagttccatgagatgttttggttctcttttctctgttt

SEQ ID NO: 6685 - DNA, 1100 bp, Glycine max
  Soy_ogl_3271 Gm09:43548301..43549400 Cluster 30
ttatttcttttatcagaaaaaaaatatataaaaaaagataagagtgaagtagaaaatgtaatgcatgtaataaaatacaacatttggacccaaaccaaagaagtaacaagatattaaaatgtatgtcaaatttttttgatagaaattacaagaaatttcaatcaccactaccacaaaatacaaaataaaaaaatctagtacttttagttatgggaatcccaaaataatgtagtatagaaaaaaattgatagagttgaagaactaacattcatgaaaaccccaatgatttatgacagttaataaagatatcaaagaggaaaaaaggtattcataacttcaatagtcattgtttctctcacttttttttatctaatagtttgaattgcaatcaaattagagaaactccagctaactctacctatttatatcatcctttgtggtttctattaattaatgatataagaactataatttcttcttctaaaatctaaactagaaattgatttagttaatttactttactctttggaaaccataagaacaaaaaagaaacaataagcagcagtgaattcaagttcttcattaaagaattgagttgtggtgggtgaacaagagtgaacttagatgtttattagcacatttcaaagcttgaattgctagagcaaacaagagtttcatgcaagaaagcatgatagctttatcacttataccaggacattttgtcacaacttttaagaaaaataattgtattaaaattttctcttaggccggttctaaatcaaagtgattgtagaaatagctacaaagcttcaaagagaattatatatatgtagtctcacactctctattcccaccaattaactatcaatagcaaaaaccgactcaggccctacatgtttatatttatcctattttgcttaacattcacctgctaataatctatttgattgaaataagtgaaaatcctatcctcctcctcccaacacctgggcgaggacattttataggtcgaacataaaatcactcaagggcatcccaaagagaaacaaaatactagatttcatatcaagcaattagcaactgtatcatttaaaacaaag

SEQ ID NO: 6686 - DNA, 1100 bp, Glycine max
  Soy_ogl_3605 Gm10:47436001..47437100 Cluster 30
tatttttctattactagtgacaacccataagtcatgctaaaaattaagttattatagagattaataatttttttatggataaatattagttggttagatttgttaaaaatgttaatggaggattttgaacatgcaatctcttactcttctcttttttctttacacttccccaatcacattaaccttattctagaatagaaattattaattaaaagcaaaacgaaattgtttttctcttccattcaatgtgcatgtgtctacggccaacacacactttctaccaacattttaatatcgtaatgtgatatatgttgaatatacaatataaagccttttcacatttcatattgaaccaataaatttatccggaaaaaaaaatctgtttgttttacaccattcttcatacaagtttgagccaaccactcattgtctatctttaatcaatctcgcggtgtcataaaaatcatactcataacaatgtgacaaacttccaatacattcctgacagagaaaatataccatgtggccattttgcacatgcttgatgacaagcattggatactggactgaaaggaatgttttgtatgtagccgtagtatattgcacttaccaacaaaagtgtagcaagtagaaactaaaatgtgtttgttcttatgcaatggtaatctatacgttcgatagcactcataaaatttccatcgataataggtattttattttccatctttctgctccgttggtcattcttagtcgttttggtttactaacggatcgatattcgttcctctaacctttatggtggtgaaatcatgaggatcattcaggcttttaattaacagtaatgctagtaacgaacaagacttcttttaaatattttattattgattaaaataaattggacgcctgaaaattgaaattgtcaattgtgcgtgaatttcatttgctatttattagtaattaagtttcaattcactcataattttgtgaatttttttaatgaatttcaagtaataatagtgtttttttttacagattaataatagtgttagatgataagaaaaaagtttcctttagtcacaatatatttcactacaggttaa

SEQ ID NO: 6687 - DNA, 1100 bp, Glycine max
  Soy_ogl_4447 Gm13:34328801..34329900 Cluster 30
cataattttctaaaatttggcatgcaggattttcaaaatggtatcacataatttaatggttaaatttatggaaaatttgcattttaaaaaattattaaggagagtgatcgtccaagacttaatcctagagccatataaaggtccccgactggtaaatttctcaagcattttcctgaaattgaagttactttatatatagtagttagttattaggatgtagaagaaaccagcagaaaacttatctaaaaaatagacatccaagcatgttagttccttgcttaagaatctagtttatatataaatacaattgccttaagtataacctaattctgtaatgccagcctgattcctttacaaatgacatttttttttattaaaacagaaagaaaaagcagaaaattgtttaggaaaacactattttggggaaaaggaagatgatcatgacttgtctaagcaaaggaaacaaaaaaacaacaaaacccctaaaaaatgagagtcatttgttttggtcaacagtaaaaggaaagctttttattggtcagctcaaaagaaaaatcagaacgcatgagcgttggggccatgacctattgacccattggtcaatccgccaaagttccacaaacttgccaattgcccctagctctgcttgccagaattttttgttatggctaaccagatatctctaatgctacagtctattgaaattaaaatcgcttaacttcattgttttataaattttttacatggatttcaattttcaattcatcctatgcatgtttgctaacatctcgtgttagagtattttaataatttatatcaaattatttgtactaaaaattcaattattttttttgtgataataaatttaatatttatatttttaaaacttctttatatatatatataacttcttaatatctcatttatttttatttcacatagaaagtatttaagatataagaaatttattgcataaaaatagtaaaacaatttgttgaaatacattattagttttttggcacagacataaaaatatattatacattatataatttaaataatgttttttttagtttgtattagaaacatttttaattatg

SEQ ID NO: 6688 - DNA, 1000 bp, Glycine max
  Soy_ogl_4806 Gm14:47518801..47519800 Cluster 30
tcatattcattatgagcaagggacgaatgatgctattcgagaaatatttaggcaagtgggtgtttcctatgtattgccaccaggactaaaattcatgcagagacatgaatcggttgctgggttgaaggttcatttttaagcagatgtgtggtaatgatttcatggaagcgtattaggtgtttttttttgttattataattataattaagaaatacgaataataaatataaattattcaattatattttaatgttaagatattaaaagataaatgtacatagttttataaaaaaaaacatttatctctcaaatttgaaaaaaaatggtttattaagtccctcaaattttgctgtttagggactaaaaacattttttttttcaaatttaaagaactgaaactatactggaaacaagcaattatttagtatatcagtcaattaattgatagtgttatttttttagagaaattgatagtgttataatagaatttgcaattgagaccaatgactgttatttttaaaatttgagtatgaaaacagattaaaaaagctatataaagctatattgaaaatgaatcaaaattaatatagaaccaatttttttattcagttttaaaccatatccaaaaaatgataaaaaaaaataattttccaacgtaataaatttctctctgaataatttaaaaaacgtacgtactcctattttaggttaatacagataagaggattaatttgtaaaccaaattttgttaattttggtaaaaagaaaagttgagaaaaaaaaaagaaagagctcaggtgtgccacctttcgtctaagaacgtagtgacagacccatctatcacagttgacacagttatcatcatagctctttttatttgcaccagccgggaatcgaacccgggtctgtaccgtggcagggtactattctaccactagaccactggtgctttatttactgctttgttatgaaaggtttaatttataatctatttttagag

SEQ ID NO: 6689 - DNA, 1713 bp, Glycine max
  Soy_ogl_4830 Gm14:48978888..48980600 Cluster 30
taggattaactggggatatctaagagttgtcatgatcaagatcatggaatccaatcttgtttgggtgaaaaagattatgttgtgtgtgaaaacagtgcactactaggtcaatgttaatcataatttggttggtccgataagtcctggtagagggttaaggcaaggcgatccattttctccttacctttttctcacttgcggagaaggtttaagttccttatccggaatgctcaacaactaggtcgttttcatggcatcaaaatatggcgtggtgccccaacaataacgcatttattgttcgtgggcaatagctatctgttatgtagagctactacgaatgaggtgaatgaattaaggagaattctggagctttatgaagtggcttccggtcaagccataaatctagtactttttttagttcaaatactgatgatgcaaggcgcaatttgctttcaaatatccttggggttcacgctagaattggtgctgagaaatacctaggaatgcctttaattattggcaagaatagaaggagtacctttgggtttgttaaagataaggtgtgaaagagaataaactccatggcgggaatttgtatccaaagcaggttgtgaattcatgattaaggttgctttacaggccattctcacctatgttatgagtgcctatctcttgccgaagtcaactatggaggaatttcaaggtatgttaaactcatattggtggggtgcaaatagcaaaggaataaaatggatgaaataagagaaattaacagtaagaaaggacctacgaggtatgaattttttagaacttattggattcaatcttgttatgcttaggaaacaagggtggaggtttatctctcagccccactgatatggttactaaaactcttcaaagccaaatacttcccttgagtggattttttggattcctctcttggtcataatccaagctattcttggcgtagcatttggagttctcgagacttaataaaggtggcactcagaaggaggatcggagatggtgttaatattaatgtttggtctcagcactggattaataatgagacttcgggtcctattggtgatgttcctcactcgcagtcaaagagctggtggttaaagatttgatgataccgggtactagacaatgggacaaaacacttatttatgcattgatgcctcaatggtatgataaaattatgtaagtgcctctatttgatgaggatagaagaatttggaagttttccagggacggattatactcagtgaagtcgacttacagactagttatgtatcaattcggagaccaacatcagtttcaaatcccaggtaattggatggcaatttggagattaaatgttcctcaaaagatcaaagttttcctttgaagggtttgcatggattgcattcctacaagaatacgactgcaatcaagaggtatagaatgtccagcttcttgccttttctgtcaacgaaatttggaaaatgcatttcactatttctttacctgtcctggaagtatttctgtttgggaaagagaaggtttgtggcacatgatcgaaccttgcttgactgtagttgaataaatctgtgagttgcttctctgattcattatattattaaaatggagagaagtactgattctattttgtaaaaaaaaaagattttcaaaataaaaatttctttgtagagaatgtgttttacgata

SEQ ID NO: 6690 - DNA, 1147 bp, Glycine max
  Soy_ogl_5434 Gm17:685601..686747 Cluster 30
ttcatatgtctctatcaaatagacaaaaaatctagcaattccctctcatttttcttcacttcttcttacttcactagacataagaatatgtttgatcgggtgaaaggaagaaaattaaattttgaattgaaaataaaataaaaacttttaaatttgttttagaaatattttttctcttgtcatttttttaattctctctaactaagcaagaaacaatatatcattgcatgtgaattctttcttctgtattttcttcctccctagctagacatatcatgaaaatctacactcaaaaagtgtctactaatattatttttttgttaaattgtaattttaaatttataattttagtttttctatttctaaatcaaaatcaaaacatttagttcccttatttttttaaataaattcttgtataatgattacgtaccgagcaatatataataagggtacacttttgagaacgatgactaaacagcatatataaggggtgaatgtatagtgaaaatggctcttagtaaccgcaaacactgtgttcgcaggcaaatagaaaaactgaataagtttgcaattggccaacaaaaatgcgcaatcaaaggcaacacaaaaattgacgataagtttgagtctgaactggctctgctcctaaaagaaaattcccaacataaaattgaacacactattcagattagtgaaattatgatattagtttttcttttctgaaaaaagtaactattaactaagatataggatgctcaatgttattagttatcaatcataacggcaagggtttactaaaatctaacaaatatttggtgtacggtatatatactttaaaattgaagaactaatttttggaaggaaagattttttttgaagaaacatatttgaagaagaaaacatccctcgttacaagctaagattcccttctgcaaatcaataatgtcgaaatttaactgaaaaatcttgatgtatttaactttgctaagttttttaaaaaaactaattttggttattgcacctaactgtttgtaatttagaggcatgcagcgtcggggcgtcaccttggataaggtttgcatatctaattgctcagcatttcttatccgtgactggttcgtatctggtcttgtaagcaaataaacct

SEQ ID NO: 6691 - DNA, 1120 bp, Glycine max
  Soy_ogl_5546 Gm17:6213601..6214720 Cluster 30
acaaggacaaagaatacaagaagatattcctttcattcaatgctgtacagtgcatccaatgatgatatctattttttcgtgtgtgtgtatgtttgaagtgtaattttaacgttagggttattataaaaatgttcttactttctcttccatctcatgttatcatatatatattcccccctcccccctcccccctttttatcaaatcaattatcacatttattatttaatttcattgtttattttgttttctttcaatttctctcgctctaccacccaaatttagctcaaaattgggtggataatgataatttttggacgtaccactttaaaaacaagagctaaacagttaagtgaggcaataagttttgcatgagaaagaaagaaaacaaaagggattgtgatgtggaattgaggcatttttatttgtgaataaaaaagaaaggataggaatcaagaggtacatttgcccgtcctaagaagcagaggaaggtggggaatccgagacccccatgacgttacgaattatgattggttgggaaggggattaggaacaagccagaggtgcagacaagacctctatccaaatgcactttggtggggggcacaaaccactatttgccacttactatcatgttgcctctgaccttgcttagttcctcaatagtcaaattgctcctctccctcacacactcaatccctaaaatatgatttctatttttttaaatagttcaagcaaatttatatctcacaagtaataaactcatattttcacttctatcttaatattaaattttcattaactaaatctttaaatatatttatctttatttctttttatctgtccatcttggaagagagtatacaagtaaaaaaatataattatatttttttttttatatttttaactttttaatataacatacattattatttccttctcatttatgataaatatgtataatacttaaaaaatagataaatataagagataataaaaaagataataattaatattgtattaaaagtttaatgtcttatgattagtattcttaaatgccgggttaaaaatcaataatgaacattagaaatggacagaagcataattaagacaaacacgagt

SEQ ID NO: 6692 - DNA, 1064 bp, Glycine max
  Soy_ogl_3618 Gm10:48238101..48239164 Cluster 30
gtgtgacatacctctcttcctttacaataattataattaaaaaaaacatgtaaaacaatgtctattataaaataaaataaaattagtccgtgtgattttatttttatataaaaaggttacccaaggtagtaaatgagctaaacgagggaagaaacagaatgttgggttgcagaattgagaattgaaaacggaacaattttacacagcacctgtgttttgttatgtgtgtctagttgagagtagagaagagagggtagggtagggttaagtaaaaatagtataaaactaagctaagaaaaggaggaaaagcaaaagagaaaattaggtttttaaccttttatggccccgatttctaaacataggtcctcgtttaaaagctatttatgggattttggtttgggcctggtgtcatactacaatagtagagggtgcacgcaatcacacaaaggctgtgaaaaagtggaattgggtggtggggtactctgaggccttgttaggtcatcattacttgctgcatcttctctacataacataaaagctcttttctctctttacctttgcttctccaccaagcctgtcattttttattaactttaactgccactcacttccttattattaatatcctgtccctttaggtcagtttccgtaaaaaaaatttaaggccaatgctaataattgtgctttgggaattggttaataaattaaaaaaaaattatattatttctattttttgtatttttttataatttttataatataattttaactaatatttcaagagcattggataataaaatcttttttttttaattttggagatttagtaaaattaattttaaatgaaattaattatttaaaactaactttaaaatgaaagtagtttgtaatttaaatgttttttaaaattatcatctaataacacaatcaatactcaaatcaaaatcaagtcatcaactacagttatgcttttacgtctacttctaggtaattggatgtaattgacgtgattttattagtctccgtttgattttactttaaaaatttaattttgagtctaaaac

SEQ ID NO: 6693 - DNA, 1100 bp, Glycine max
  Soy_ogl_1117 Gm03:46953501..46954600 Cluster 30
tcaaatgaagattgtagtacggcttaagaaaattgatgcacttcttctacttgttttcttctttaatccaataagtatgcacttgtctgtataactcatgttatatacatcatattcataatcaatgttgtcatgttaaattattttaattaataacaattctaacgttttggttttaattacttattaatttattatagggtggcgataatgacacgtactttatatattacttattgaaacagaagcatctttatttttaaaaataaacagaaaaatagttaaagaaaatagtgataataattttttttagagaagtaacagttacattttgaaagtttaagaagaaaataaaagcaattatatatattaaagggtagtttaaaaataaaaaatgcctcggtgtgctagcttctttttctttaatagtttgagttgcattcaaataatatgaagaaacacttcatatatataattaaaaaaaatgtaattttggtttggtgtcctcccctcttttcggtttgccgtcgcatatattattattggcctccgtttgttaaactgcgttgctgtttatagatttttaaaaagtaaaaacaaagccagcatgcataattcgattcaatctctcaaactgaatttcactgtatatttggattattttattatgtatttgcaatattaaaattattttttttgttaaaaaactccataaaacttctattatataaaaaaaaaatatcggatccaccctgtcatgattataggcaaaccaagtgaatataataaattagtaagaagcataaaaatctcaccaaaaccttcaatgttctaagtacataaatttaagttcattaacaaacgtcacttgcaattaataatgcattcgcatagaaattaacttatcgaagctttttaatcagaaagtttataattgagtcataaaggaaggtcatagtctagccataatcttaagccacagcgtaagccaatggcaattcaaggcataatccttgggagagaaagcaaaccattggctgaaacgtttattgatttattttgctctcaatagactggatcttaagccacttttgctttcc

SEQ ID NO: 6694 - DNA, 1100 bp, Glycine max
  Soy_ogl_700 Gm02:46573201..430300 Cluster 30
ggtgaacaacatttatttggacgggtaggttggacgcaatataacatccaacggtcttgctttactctgtttgaagtacattcagattagatatcaaaaattcaaaatcacttttctggtttgcgctgaagaattatgcgcatgcacatccaatgttgattgttgagagaatcacacgaatcacatatatcataggtcagctttggggattaaacattcagtcattcaatatttgtgttccaacatccagtgcaaaccatgtgcattccatttaacattaaacacgggaaaattatgtcaaccatgtttttgaaaatttgtctttacatttactagtggttgaaaattaaaatatagttgtatgatttttagtctcttcttaatagctaattttactaattattaaataaaagagtattttcattttttttatgttttgaagatgttttaggctaattccaaaaccttggtccaaattaaagtataaaaacaagtctaaatctccatagtaagccaaattagcccaatccaaacctatctggctgggatatcacttaacctgacaaaacagaacgatggcaccctaaatgtcactttaacaaagtgtattacacaatcaagtaagaactctctttcaagatccaatagtaatatttaattatctatctatatacattcactaaaacacaataaaaaaataaataaaaagtcagacaggtaaagacccagaaatctattataaaggggggcaaaattttttttttcttcctttataaaattgtttaacttttcaaataaataataatttttaaaaaatgtttactatttttacacataaaattgaaactaaattttattttaaatgataataaccttaactgttacacataattaattttatataattttacaccagctagagccttaatcattgtattgcacacctgtttttacacaattttacactatctaattaaccttaactattattattattattataataacataaacaattaattttacacaattttatactaactaatataaaaatatacatgaaaaattctaaaggagggactgtccccctaggtccgtcc

SEQ ID NO: 6695 - DNA, 1066 bp, Glycine max
  Soy_ogl_1059 Gm03:42971735..42972800 Cluster 30
ttattattttagaattctataaattgcacattttaatttataggaacatttttttcttaaaatcctttcaataaaaaatgcaaaatcattcgttgttaattgaaaaaacaagagagctaaatttaacaactgggtgagctattatgcatataagtatttttatcataattttacttgttaatcttttaataaatggttttaattaaataattttccttttagtgaccaagtttaatagagttaaattctttattttactaatgaaaataaattggtacatatattgaattgacaaatgatatttctacaataaaattataaaatttatttgtaaataagaaaaaaagaagaagagagagatatacgtaagataaaatgagtaatacaatgagaaaataaaaatgaatataaaaatatacctctatcaaaattagatgactgaatacaaaaacggacagtattatttgaaacagatccccaaattccaaactacccgttatccaataaagacctaaaattctcaataataaaccaaaatcctatcccttttgtttttggttacgaacaatcctatcccattgcattggaacatggcagtgactggaatgaaatggggaaaagatgaaaactctgactatcaagatcagtcgagacaataaaaattaggaccacttgaaaggctatttgttttctttcaattttcttacacatggatccatgcatggtagatggtaaaatggagagggatatagtaaaaaggaaaattatttttggtttgtgaaaatagatatgacatcattaaataagataaaagatctgaacagcgcataactttcataaaaggttggaatatgcacaaagattgaccaaagtggcacacattgtcacattgatgctcagtgcattgtaggttttattggaccaccacctatatattagctaatgcactaaaagtgtgagagcgaaatggtgcatatatgaatgggattgtatttatttgtctgcgtatcgatttaaattcacgaattccctttttgttcagttcaatatagtattcaattgaggg

SEQ ID NO: 6696 - DNA, 1107 bp, Glycine max
  Soy_ogl_1184 Gm04:2344701..2345807 Cluster 30
gttttctacaaaccgaaacatacagtcacacaaaatgatggactcattgaaaattaatcagagatcgtttctcactgactaatccgtccgctgcagtccaataattgctatgatctctttatgtttcttccaacctacaactacaaactcttcaattaaaaaataatttgaaaaaaaggagatggaaaggaattaggtggtcgggtttctgggtcagacaaattctaattccactttggaataaaaatagttaacaaaactctgaataactgttataagtctttcttactttggaaaatattttttatttttactcataattataaaatatttattttataattattaatacattttaaaaaaaaaaatgcgtcctaaaattttaggacttggttttgtccccacacccccacttaataaagtaagcatagcccaaacaaatcctctcctttcacagtcttggatcgagttcctagttgtatattaccatgtttgggaccttttttttactgaaaaagaaagaaagagctactatatgtggacagcccagttggacttatctattacaccacactgtggaaacaataattggttgtcattctgtctttttgcattctttttttcttatttccctctcaacatctttattttttagaattttcaaaatgctgaaattgtcccttccttctctcttttaatgaaatacacaacttgcaaagaggccaatctcaagacaatacgaggaaactgaagaaagtagttagttagttctggaccaaaagatagaagtaacaagataaattagaaacgaactgaaatcgaatctctaaagtccaaaagtagttagttaggtttcacagtaccgatcgttataaaattagagcttgtaaaatatattactatctctctaatattatttgtattttaaagtaatgcattgttttcaagaaaattattacttacactaattattatgatacaatatttttgacaaaaatttctttataaaaaagtaaaaaatataattgagtttatttaaatacgagtttaatttctaagcaaggttaatatgaaagtttttacacttccagctaattaaaaatcata

SEQ ID NO: 6697 - DNA, 1000 bp, Glycine max
  Soy_ogl_3624 Gm10:48548701..48549700 Cluster 30
acataaatggaaaaaaaataaattgggagcgactgcattgattgacttgcctaattgcacggccctgacgccctgtttcttgctatttttcatacactagcatccgcactttacaaagtgtaaaatgtctatatttacatcaactgatttttgtcaaatcataaaaacattctttttctcttacaaatggaaaaaggcctaacaaaaacgataatttaatactgtgaaattaaaaaaaaaaaaagtgaagtgcaaaaaccttggtattattgacatgcattattttagcaaacaagtccaatgattcgtaatttaatctttgtataatttttttataaacaataaaacttgagactgaatcttcaatctccgcatcataattgcagccttgtgttatgacaagtttagtattacgagcatcaataatggtccagattgtgaagggtggagaaatataggaccatttcacactcccttgttttcagtcctagctgttgttgatcgctcaacaaaataaaggaggctggcgccgaatggaaacaaaaaattatgtaattgcccaaatgaaaaaaaaaaatcttatctgctcatgacaaactatagattttccatttctggcatgttttactttcatgtaaaacttgaattcttatccctaatcatcaaaattctatcatgaaaaattaaagtacaaaaaaatgttctctggaacaacctagacaaatgagaaaagatgtttcataggtagcagaaaatgaagaataaaatttattttaaaatattttgtgtttaataagtatttattgtctatctgaaagcttacactgttaattagtcaaaaaggttatttttagtatgacttttaaaataataattataaaattaattcagtaaacttacaattactatgtgatccaggacatgtattgtttattcaaatcacaaattagtggcattgaatccactagaggatttggatgggaaggtttccttaatttct

SEQ ID NO: 6698 - DNA, 1022 bp, Glycine max
  Soy_ogl_3980 Gm12:2778401..2779422 Cluster 30
cgttaaaaatttaaaataataattttttttaaaagacttatgtaattcgatcatttgtcataacaataaaaatataaatcttaccttttttttttacaggaattataaaatgttacttacggcaacattaattaatacaacaattattattttttcaaatattaagcaagttgtttagtacaactattcttataaaattaaattaaaaaaaaacttatttgaggtaataaatgtgcctatagccattttagtgtacgcaaaggtaaatcttgcttttggtgaagatctggcgataagtggtgtcgaacatggattagaaaggcgtcatgatttatgggacccacatgaattaattgagatttgagagattaaacagtgaagttgtttcttggcaacggccctttgggatccccttctccctttgtcttattagcaatttagcataactcgcagtactttccatatcaaaccaaacaccactgccactcataaaaagctgactctacttgcaccttttgcactctcttcttcactagttacttgtttagataaattattagactgttttaattttaattcagaataaaactaactctacatttaaaaaatatatcatctctattgttcagataatggatctctttcttttgataagttgccgaacacttaaattaattactatttatttaaaaataaattgtttttttaacaaattttagcattctttaaataagaaattgtaaaaaaaatgaagtaaacatgtaactaatgcaaaatattacttttttatgctagattgtgaagagagaaatagagtgtaaatacaaataaaaaacataacttaaaaaataaaattgaatgttgagcgacttaaatgataagaattatacgtgaaatagaataaaaataaaataataaatattaaaaaacactcttatacccttattatcgtggattaaacttcttttaaaacaaactcaacaaggttattcaggcaaaatcatccccttttctcacttttt

SEQ ID NO: 6699 - DNA, 1100 bp, Glycine max
  Soy_ogl_1125 Gm03:47232201..47233300 Cluster 30
aaaagagcattctttgaataatgagtgacaaacaacttgtgtcacaatcaaatgttttatcacgccgaacaaaccttcaacgaggacaagacattttcaattctacttctctgatatgtaatttttcaacaactacaaccttcacccgcagacccaaaaaagagacacaaaggtaaaacacttagacggggatatatttatctttatgaaatattaaaaatataaaggtcatcataacataatttattttaaaaaataatttaatcaaaatttatatatacctatactacaggacatatttactgttcccccaaagtaaaaaaaaaaaaaaaaaaactggaccaccgtaacattggcccaagttcgatgggttaaaagcagacccgctggtctatttagaaagatttaaatatgtgaatttcaaaaaaaaaaaaaatgtgtcgattccttttttgttcacattagtgttgggaaatattgtaagaccaagcgtggttttggtccaactttttactagcatgctcccacacaattttactatgatgttcttacggaaaattattatattagattaatgatttgacatggaagaagttttttttttttataaaaaaaatatacaaggatggaaacaaggtttaaacttagaacctgaagtaactatttattgttcttcttaatcatgaaaaaatatccgatcttaaaaaaattaacaataaaaagcctttacattttacgtaaaataatttaattctaaatttcaattaatcttgaaacctaaaaattaactacaaaaagcatttaaaatttaaaataaatcaactgaagtataggatttttaaaaaaataacaatgttatacatctagagtatgacttactccacatgaaaaacaaaaaatgtacgataataaaacttatccaaactcgattaaaaaaaactaaaacaaagttgtgcataaaaaatacgacttgtctcatttttttaaaaaaaaattgtaaaaatcttcattacaaaataagaatttcattttttttagataatttctagtgggacttcagttttaaaagtctgaacctcacgtgtcatttatttgatgta

SEQ ID NO: 6700 - DNA, 1079 bp, Glycine max
  Soy_ogl_2884 Gm08:44285622..44286700 Cluster 30
tagtataagaaaaaaaagataattttttttaaacattctcattgaaatgtaagattcttccttctttagatagaataagatgatgaagaaacatgtgtaatatgaattcttaaaaatataagattcttacccctttacacaggaataagaccatgaaaaaacatgtgtaatatggattcctgagaataaattatatcaagggatattttttattactttttaataaatatgagaatatatactttcatcttcatatttccataaatccaataagattctattagacaaagttaagcatttaattccttatcggtttaaattcattgacgacatttgatagttgacgagaaactaaaaacataaaataccaaaaaaaaaaaaaattacaggtggccatgaaaaaaaagacaataaaaatataagcaaaaactaaaagtggtaataggaaaaaacaaattcaaggattttgatcggttataatttaaattataaactaaaagaaaaaaattaaggaccaaaaaacataataacccttcaatatgatataaaaaaaaaattaaattgacaaaaatttgaaattaaattcattatttaaccacttcatctttgagatggagccatttatactttattttctttggtaggataattgtccctggacgtaaggcctttaccattgatgtgatagtagccacctaatgggcttttgagagcagaattgtaaatgaagaagcccaaaagagaatataggttttatatgattttaactcctaattttaaatatttaatcagcttaaataaaatagattaagtaccctagcaaaaagtcaggatggccgagtggtctaaggcgccagactcaagttctggtcctcgtgagagggcgtgggttcaaatcccacttctgacatttttatttttaacgttaatgttatgccaaatctcttaatttgagacatttgttttcattattttctttcttgattttttttatatatataacccgtggtatgttgactagctttaagtcttcaactatagtttccaacctaaaacttctaaccccgatttaagggagg

SEQ ID NO: 6701 - DNA, 1073 bp, Glycine max
  Soy_ogl_3260 Gm09:43149701..43150773 Cluster 30
tatagtgtagatagtattctaaatagcatttttttattattcaaaatatttttttattgtaaaatgtcatctaaaatattttaaggatgaaaaataaaataaatgtattttgcaaagattaaaaaaaattacaggacaaaaaggaaaaaaataataaattgcaggaaaaaatatttaaccctcgtaaaaaatgtggcgaatttatcaaaagtcaagcaactttttattagcttgtttttaataaggagaggaagtaaaatataaaccacagtttgttagtttcttcctcggaaaaaatcacgctatgcaaagaaaataaaattgttgataaatcatcaatttcagattaacctttgaaaaaaatgcaatttaaaatcttcttctccaccatttaagtagaattaacttcattgctttgttttaagagaagtgatgaaatgaaaggtgtactgataactatgtgtgtcgtgtgcaactgtgcatggacttagcttctggtttctattgttgatttcatcccttccttttatccaaaccacagaaacctctgcctcatctaaaccacccattcataatctcaaagcaaaaataaaaaccaccccatgaaaataaaataaaacaaaactcgactcactacagattcatgaacccttggtaatggttgaaccaactaatgaggtggcatatccttcttcttacgaattctgcttataaaaataattaaaatatcaaaataaagaaggatttttgtcgtaatatattacaatttttttaatataatttttataataataaaaactagtttccgtagtggattttagaaatgatttccctgcaaaataaaaaaaaaggaaatgaatgtaaaggtgaaagacgacaataaagatattttagaaatataacaaaaaaaaagtgggagcttcaacaatgtaaatgttgttcttgatagtccttattggggcttttcttttaatttttcggtgagatacttgagttttcttcttgcagtcattcttcttctacattcaatatatttttttataattttaatattgtccttacatatctatata

SEQ ID NO: 6702 - DNA, 1200 bp, Glycine max
  Soy_ogl_340 Gm02:3088601..3089800 Cluster 30
tcataagatgcaaagccaaataaattttcggatacttttgtattccttttttgatgttgttgttttttttttttgtatttctttcattttgtcattcctagatttgaccaaaaatgtttctttgcacaacaaaaccttgcttttctcacccaacaccaataacaacattgccaaatgtgatatgagatattacaagtaaataaaaaggttttcaaatgtttccaattcacaattacaaaagacacataataaataatctgaaattccaaatgttattcgactgaagttgcaccactaataatgttaaacaaatcgtatgctaacttgactctcatgatattagtacctctgcagctctttctaagaaataagaaatacatagaaatagtttatcaacaatttcttaaagaacaaagagctctccttggattccagtgagatactacacatgtcttcagttcaattattgttttccaaggcagatatataacaagagaccaatatcgttaggtaaagaaagttggtcaacttagaagaacatggagagcaagataaactcattaaagatagtagtttgtcagtaaaattatttagctttggtttgagatagaaaggaatagtccgagttccattactcacatccacaaccatcttgtctatttcagtaaatgcttatcttctctactgaggcatggcgtgctacttcccgttggactctaccaataatgaacgtttgaacacgtccaagagagatacccaatagttattgagccttcaaaactgaatggaagagggagagacgtcaacaaatgcaaaaaaaaaaaaattgtttaacttttgaatgttaggacctttagagatattgtacgtgaacgaaggcacaaaaaataaagaaaaatagtgctaaaaaatccaatttggaggcaactcattatttttgcaggaagttcaattttgacacatgcagaaataggaaggacttttcaaacaactcttcagcagaaccttaattaaaatatcaaatataacttcaatttaaaaaaaataataaaagatcaggaaaatagaaaacaaaaagcaatacagtataccctaccaatagggtaagacgaatccactgtgcttgcatcataagttccttttggaacatccctaaaaaaatacaactcctagatcactgagacaagctatcatgagaaa

SEQ ID NO: 6703 - DNA, 1100 bp, Glycine max
  Soy_ogl_4849 Gm15:1083601..1084700 Cluster 30
cttctaatgagtttaaatttcgtttattcattttctctgccttccaattatatactgtattatatttgacagaggaagcatttaagttgttaattgattaattaaccatactcgtagggtctatgtataaagaaacacactatcacgatacaaaacttagatacaattttatagatattgtttgtattattctctaattataatttgagttttatttcaataatttacgtgataaaaagtttgcatgcataccactgaaataaaactctaattttgattaaaaaaacaaataaataacagttaagaaactgtatatagattttgtcctaactaaaaaaggaactacaaaaactcgctaagagcttattcaaaagaaacccacaaatttatatgatttttataaatttgaataaatcataaagagtatattcagtagagtatattacagatcatattattagcacatttctcgtacttgcacaagcagactaatacaattacacttgtatatttggccacatcatttaagactaagaaatttttaattaacagattagttaaggaacatctatgtagacgtacgcaaaataattacatcccaacaaaaactctaagagcttaaatgactgcaattagttcaatataatattatagccgcatcttttttttttttgaagaaattatagctgcatcttaatatttccttcataaagatttatcatatataaaaaaaaggattgaacttacccaaataaaccacaaagaaatgcttgacagagtactttcacggttatccttggcttgctctttctgtggaagcataaatccacgacttcaattgtgtttcgataaataaaacagtttaactattgagcatcaagtgtgaaaatagatgattatacgaagagtgggtgaaaaaatatacacataaacattactcgttttcaaaatctacaaagtcacgtgtttatattagctagcaacaacacatgtacatggaaagaggaatgaaacatgggagaaccaaattataaaaaaagttggcatgcatggatgcacctatcgacaaagtaggcaagaggaatcatgaaaacagaagt

SEQ ID NO: 6704 - DNA, 1003 bp, Glycine max
  Soy_ogl_4855 Gm15:1561098..1562100 Cluster 30
atagttttgtatttttttaaaaaaaatttctttattttaacttccttatatttgaaatttttttatcatagattcttgttgttagctcggtcaatttagtattaacatgttagcatataacatatattggcacatgtgctccaaggataagttagtattttttatttattccttatagctttagaatttttgtatttgttccctataattttaacaaattttatattttctcttatgacaaaaaatttcaaatatcaagaaacaaaaaaaatacaaaaataaagtatatattagagagcatgaccatatttagctttagaaaattagtacaaaacctcgtccaaaccctccgctcttaccacaaatctcacttgttattttcttttaaattttgatttacagcgtattgggttgagttagaatgatcgggacgatgaatgaacaaaattcaagacatctcaccatcatctgatttcatttcactttaatccttattgaagtatctaaacatgcatattgataaggtattagaacaaaatcgaggatactgtgctgtggtgatccgatacttatagggattaattaatttgacaagttagattgagtctaattcaaatttaattttttcacgtaaccctacaggctacaggttgcaccacttttgaactcgaaagtattggttaagtggaataaaataaaatctcgcgagttttgtataaagattgagtttaaattattactcgtatctttaaggagagatatatataaatacctctgtatataatatatgctcttgaagtttgatgatttttcctgctttaaaaaaaaactacgagttttgatttcgcgagaggcacagtaaatttatgaagcattgtattttgttagaaaagtgttatcgatagtgagtcgttatcaatttcttgatttgtttcttgatacttaatttctttttcatttttagtattaaatttcactactattgggaagaaataactaataa

SEQ ID NO: 6705 - DNA, 1109 bp, Glycine max
  Soy_ogl_995 Gm03:40201092..40202200 Cluster 30
cagtacgtactagagaagagatttgcaatcatggtttaacttaaggagtttggcttcgcctatgtaattattgagatattaatcaattcttccaattggcaatcactttttcttagtctattaaagtcatttatgatttatataaacatccatcgacctgagaaaatcataacctcgtaatgatttgaattttatcattcttccatttttttggcaaaatcatcaataacttattcataatcaagatttttaaataatcatattcaatagaaatcaaaacaagtttatttaacctaccttgtgtcatagtttcagataagattttaacaattttaaattcgataaattagtttttttttagtgtatagaataggaacaacaatagttaatattcttttataagttgtatatgcattagcaaaacaattaaatgttttcgaataactaaatcataaagtttgattttgattcattgttgaagtttgaatcataacaattgtaatatttttttttcaaaaactttgattatgtaattatgttaacactaatagtaatggaaggaaataatttgttatatttttctcttttacgcttaacattgtacttaaattattgattctttttctgaaaattgtaaataaattttgttgataagtttaatggtaactttcgatcggtgacacttgtttgttgaagacttcaagtgaactttatacttggaaaaatcagtccattatttcatttctatttaactatttaaaaagatcaaatttctactcaccccctccccaccattcatcacctcacctacacacatggcccattttgtttttcttcatctgtttctcacagggtatcagccaggcccattttcatcatgtatttagttttctttttctttttttgttattgaggaggggcaaagcctctaaacactaaactgaccctcccagtcctaagagagatcacagaggacagatccagggggtatgagtacggattgcccaatcatcacttggagtgcctaaaacaaataatgagatgccttaaatagttacccagataatcctgaaccagaagcctgttacaagcaacgggagcagaaataa

SEQ ID NO: 6706 - DNA, 1111 bp, Glycine max
  Soy_ogl_1533 Gm05:1916290..1917400 Cluster 30
tgggaaatcagaaagcaagttgtgcgagcctggaaaggtaagtaggtaacgtctgagacatttttcccaaattactgggaagtaggaaccattgtcttttgatatcaagatttcatgtttatggtcacaaagctcagaactcagaagcaggaacattaaatccgtacacaactaaaacgggataacagcagcatttatttctcttagctgataaagtctctatcatatagtaatagtactagctaatgtgtggcttctagctgccaagcccaataaattaaaaatggaaagtcactcaactcactgccaatagccctgaattatttatatatagctcatgagagcaagggtaattcatgttgatataaattgtaataagtaatcacttctagtaaaatgaaaaactataaaagctagagtaaaatgattagagcatgtttgtgtatccgtttcaaacgaacattgattagcaaaagtatcaacacctttccttttgcattcaatttgcgttggaccgctggactcagaattcatgtggcagcaaagttggaagaaaaatcaaacatgcactaaatagttaacgttaagaagcttaccaggcccacagaatctttctgtagcttgcaaacagagcgcgacaacctgatcgagggcattttgcgatacaggacacgtgaggccagcagaatagctagaagacacgacatgtttgagggataccgtagtagaacttacaagatctaatcatgtaaaggacactgaatactctctcttgtgattggacatgggggctatctttcaattgagaaaatagctaaatatgcagtaaccacatgcacacaagtcttagtataaaaaatgcgaattgaacaacatagtgcacactcctatcaattaatcttggtagtaaagaaaactgctgtactattcatgtggttatctgttgataaaaagaaaagaaaaaaaaaacattttttttggatgaatccaaataatctcctagttgagagttagagattaattccttgaaatactagtatttatttaaaagactaatctttcacgatagatatggacttggggatcaaccatacaataccatgctaaaaaa

SEQ ID NO: 6707 - DNA, 1076 bp, Glycine max
  Soy_ogl_1776 Gm06:3149301..3150376 Cluster 30
aatacttttagctattcctaaacctttctatatagtcatccataaaatagtgattttgttcttatgtggatttaatggtgtgtaaaaactagttcagtaaataaactaaaatatattaattttaaattgttttaattggttcagttttaaatttaaataatcaaactgatttaaaaatcgattcagaatcaaactaattttaaaaaattaattctaaatggaactgatttgtaatcaattttaaattaattttaagtattggatcattttcgaactaattttttaattgtttcttttttaaaaaaaacattaaaataaaaatcagttcgattaactatatcgattttgtaaaaataattcaattaattgaattgattttatacaataatgcaattcttttttcttgaacaaatacgtgcattgctatatatgaattactaacaacatggtgctttccgcctttccccacctatatatagctacgtacgtcaaattcaaatataatgttgatgggtctaagaggaactcaaacagatcatgatggtgtgatgtatgaagagtcttcttcaatgagatgatggttctttcagaaaaggattccacgatcaaagctaaaatttagggattgatcgatgatatatggttctttcataaaaggattccacgataaagccaagctttagcttttaggggattgctttatgacctcaaaaattgctggttcactttgcatccggaagttgatggttggattttgaaatagcattgcttatatacggttaaaacccattgttcattaactcactcaccaatgtttgcaacttggtaagagaaatcactgttctcttgtagcagcatgaatgggttgtggtcgtgagtcttgacacgtgttttttgtaaggcaattcgatgtgcaaatcatatttactaattaactttgggcatgcatggaggtcttggcctttttcaaatgcttgatcgtccccaccagtctcttgccagctgaaggaaaatgtcacaagggtgtctttaccttgtttttttcttctttttttagtgttctatttcttttgagc

SEQ ID NO: 6708 - DNA, 1100 bp, Glycine max
  Soy_ogl_4419 Gm13:33136801..33137900 Cluster 30
accaaaaagagactggcatcgatccatccgtattgagcttctgtgaatgtggatttcataaacttcaatttcatgagtttattagtagtcttggataaaaatactttttttggtgaaaaaaaagtaaatacttaaagcaaaacaattacggctcattcattctttttttaagaaaataacatttataattaaaaaatatatgcatttacaaaagtttatggtaattgataatttattaaaaattattttttaatattttatttgtaaattaaagaaagttgaacaaaattacatcatcacggtttgtggagattgtcacatttatttgtaaaagagagtacagtttaaggaataattggaatgaaactaaagtgtaaagtatctacttgtaaaagaagtaaagttgaaggagtatttattttccttatatgaagacttggagaaatgctgataaaactgtaacagttatattaatgtcatattacatacaatattttttttttaacttacagcaatacaatgatttgttagaactattagcataggttcacccataagcttttttttttagggataaccgtaagcttagattgtaagtaattttatttgtttattactatttaactagtccttaaatgtcattaataatctttctaagaagagtaatctaccaaataaaattttggcaattacaggaaaaatcaattgatcgcgcctacaaagaaaaatgataagaattaactcttggtctcttaccattattaccattccaaattggcagtcatttggactgtacttgggactcggtaattatcacataattaaattcatgcattgtcaaaagagaaggcaaattggcatctaaaggcacattgattaatataagccagattaaaaaattaatgcatataaagccaagtagccaactatccaaatatcatatatgctcatgcatcatgcattcatcattcttattgtttagacgataaaaaagtgaaaaaactgatgtgccaaactaacgtggtttccacatatcatcatccatcactatgctacacacgattgcaaagaacttttaatttttcctcttggacaaaaag

SEQ ID NO: 6709 - DNA, 1000 bp, Glycine max
  Soy_ogl_4593 Gm14:762901..763900 Cluster 30
tgtatttttaggagtttaattccgggcaataatttctaattggtattttttttattcatatgctgtaattggtatgcctaaatcccactaataagtgtgtgtattttggtttttcaaacagacaaatgaaatcaaagtgaactgttattaaaaatctgaaataattttgtcagatatgtgactgtactatacgtgtctctgagttcggccccacagtctatgcaaatccaatgaaggggtctctctggttggagaatgagaatctcaagaaatttctcatacgggaatttatttttctgataaaataagagtagtggaattgatgatctatacttatatagtgtcccccgaatattactattttttttttggctacttggtttataatcattatttgtagctacacccttacgtgtgtaaatgtactcatgcacacagatagatactttggaattaaggttttaaattacgattgtacgtattttcgtcgttttattatattgtaaaaaattacagataaatatatatataactacggttacaaatacttcaaaaatcttaacaaaacaaaattaaaaattatagtcgtagaatatcttttgaaaccttattcggagtaaaggaatagatcaaagaaacgaattgaatgttgtgtgtggtgtgccatatgtgatatgtggtaatatttttgtacatgtataacgaaataattaaggaatatccttgtataaggatgtatgattctttccaagatctatttgtgtgggggtagttgtacttacaaaatttttaactttatttatttatttatatgatctcttaaaatgggcctaaaagatgtacatattatagaggccagaatccatactttctgacctattgaattaatcatgtgtaaatttaaatacaatatatagaaactaacaaaatttggcatatagttgacagacaataagttttttaagcatacggattatgatttaattttcttactatatat

SEQ ID NO: 6710 - DNA, 1000 bp, Glycine max
  Soy_ogl_5451 Gm17:1872101..1873100 Cluster 30
tttgctgatttttgtaaataatcaattttaacaaaaaactattattttttatttatttaaataattcggcttgttaacctataattttttaatagtttaaagtcagctttttttaacgaaatagacttttatataagtttttggcgtagtttaaacattgctaaatgtaccccctttgaattttagatattttttttcttctaaaattatttttaaaaaattaatttctagaatatatttttgtccatggataaatattccataaattaatttcgaacgcatttaacacatttcagaatttacttttggaaatccatccctatttctatagttactgattgaaagaaaaatgtattgggagttcttttttttttttttttcaaaatattcaccggaatctctgtatgctacatttttatttttcagtatgaaagttgcttgctatctcttatctctgcatgctacaatgggtttggtttgaatagcaacatagaagggtgagtttggttctacgttttaagatcagcactaattcacgttaaacttcagatataaggcataagtaacaattagtgcgtgtttcatgtaaatattttttctcttttcaatcgtatgataaaattttactgtttctcttattacttccttctcaactccttccattccaacagaaacaaacataacttgggtgttggcatgtgacataaacacttcgaggcttcgacacctaccaataaatggagtgggcctgtccctctcttgatcgtaccacactcacactgttttgtttttggaagaaaatgggctacgatttgtctctgcctgcaccaaaaattagttttgcaaaatcataaaattcaaaactcaataaataaaaaaataccaacaaaatccagcgcactttaggtagattctttggtggtcctcaaactcatttcattttggctcttttttctctatcaaagcagtcaatttctaaattttcatataatccgcccag

SEQ ID NO: 6711 - DNA, 1197 bp, Glycine max
  Soy_ogl_3262 Gm09:43192201..43193397 Cluster 30
aaacaaaaataatttatattttcttaaagaacaaaatgtttgttatgcttaatatctttaatttggttagtttttgttaatggaaaatttaaatttatgatttttttctcttctctatttatcattgtattaattttatatctcctttttaaaaaaataattaaatataatttcaaattaattttactctcaaataagtacttttatatcttttcatcgaaaatccaaatataccctatatcaaaagctctttgaacgtggattttttgatcgagtgagggcctggttccacacatgcagctaatctgtgttcgtattctataacaagatatacgaatacgatgaattgatgtggtacgaaaaaattcataacctcacaccgtctgccacagctttatttttgaataatccaactaatgaaaacaaaagttgattcatatgataagatttatatctgaatatgcatttaatacctgttattgacatgaaaacctatgaatatctgtatagctttttaaatcttgagagggtcttggataatctatactcattttgtggtgctggtgctgggaaaggaaaaacgaggagaagaggttttagggaagtgatagacacgcgcaaggaaggagcgtgcgatggagagttgcgagagtatccaatgattattaggagattgcgtgtctggttacgaagacacaaagcgacacgcacgggggcaatcatgggaccaggtggcgcaacatgacatgcccctgcacgtgaactccgatgtgttccccacgtgcctggttcttctcatactctaatctcaattttcaagttttacccaccaaatctttcatggatcttttgaaagtgtcaattctcgtgcttctgggcacgccctttctttttcattctatagagattatcttcaatttctggccatccttttccttactttcaagtttcaacactatttttctttttcttctaatttcacaaagctagtgtgtttagataaaaataaaactgatatgaattacacacccctatactcttcttttatccaaacatactaaaaacaaaaacaaatgtataggttccattatacctttctgggaaagaggaaataaaatgtggagagaaattaaaattttaaatttaaattaattgaaaataaaaatgttcttttcagttaaaaatgtttacgtagtc

SEQ ID NO: 6712 - DNA, 1142 bp, Glycine max
  Soy_ogl_4542 Gm13:38240401..38241542 Cluster 30
ttaaatgtatttggaaaatgcccgcaccctccaaattctggtgttggcttggagaattattcttaacagggtgcctactaagaaggatcttttcaagaggggaatttttaatcaacatgaagacattgtgttttttccgtaaacaaatggaagaatctacttctcatctcttatttgcgtgtaaaccgtcttatctggtgtggatgaaatgatatgcgtggttggggttccagttagcactaccatcggatccggcttcacatgaggcaacacttgggtctgatagtagggaacaaaagaaggaaaggaagtccatatggtcattgtggttatatagaaatgatatagctttcaacaacttcaatgaaggaacagatcatggtattggttaaaaggaaagctgcagggattcaataattccttctaggagtgggctatgcaaccaaagtcatgcttaaggtacttatagtcacagcttggtttcaacgtatttggttggatatatcatgtatggggtaatttaaattgtctatgcggagtaaactgtactaagcatccttgtctctgtaatgtttttcttattcgggtatctctggtactctttaataaaatgttttctttttgcctagaaaaaaaaactatgttacaatttacaacactatcacttacgttaagtctccctcccactaatgtttccaacgtcgcaggaaaaaaaatatcggacataataaagagctaatacttctgtaaaaaaactaatacatgcatctgtcatgagactcttgactattgttttaaaaaattgaagtatatagtcatttggaaaaaaaaatgaaaactatttttttaactttttgaagaaattttttcataccaaaatcgcttttggaattgaaaaaaacaataaattaccagccaaagtccatagaaaaacaataaactatttttcttgttttaaagcctatgtaatgttaaacacaaacgttaaagaaatttcttattttgggcaatattgcagcatatattactttttagcatctaaacttatgttacagttttttaaaagcatcataaattacagaaaaaaataataaaaagatgcaagaatcagctatcaccactgcacctggaaccaaaacatc

SEQ ID NO: 6713 - DNA, 1100 bp, Glycine max
  Soy_ogl_2558 Gm08:8275801..8276900 Cluster 30
gtccaatttttcagttatacttttgatttttatagggtaagtactaagtaacctagctagtttcttaatctcatgatctcttggcttatctttttttttttttaatttgtgcttgagtcactatacatatttacttggttgtcgaacaaaattaaaatttcttcgtacctaaacaaaacctaacttaaagtcccagactaattcaacaataatcaactcaatttttttttttttgcatgttacatttcatacattaactgttgagctactttatgggttccctcccgtgtagggtttgtttaatgatattagcttgaagttttcactcttttgatcttcaagaagagttaaaggtggacatgtctgtaggattgtcagcaatcttttcaaaaagtatccattctctatgtcaagcaattttttcagaaagtttccctacttgattgagggtagttttttcttaatactagctgagtgaaagaaggatatatatataatccaccggcagatttgggttctgttaagtgatcagttatttctaaatcaaaccagaaattgatcgaaggacatggaagctttagtggaaacaagaggagaaaatgagagaatttgctagctaggtggaaagctcaacatcgcattaatccttgtaatgaaggaagcacaaaactgctttcattgagctggtgtcaaactaaaggcaacttgaggctgaactcggtcgtgcggtcaagcaagacatttctgtgtacgtagctgtacaataatatacaatgaattagaataataacagattatgtggcattaattattacagcagcaactcattccttgattctgggaattagcaatttcttccagcttatatatataccagcatctcaatccttgattgtacgatataattttgcaatttgatccaaatttattacagctagttaggatactactcgtcttacaatttttgacaaggttttgtcagcaatgttgaggatgtttaagctgaacaccgtccgagaagtaaaatactattaaaggaggctaaaggaatatattggattagaattttaaaagattattttaatataaaaggttatatg

SEQ ID NO: 6714 - DNA, 1000 bp, Glycine max
  Soy_ogl_2587 Gm08:10041301..10042300 Cluster 30
ctatttctattaaccttttgttagtcactcactctatatctaatagtcacattatattttgaccaatttaagttgagttgagagaacttgttaaaagagttaaaaactcttttcgatgtttatttttaatttccaagattaaacaaatttatttaaagataattaaattccttgtcacttagatcaataagtgttggtataaacatataatgtcccaacaaaataaaggctagttggtcaactttgttcttggcctaaatcagcaagcaatttccttaaccacgttgcttgatttgcagcaggttgtcaaactaaaaaatttaaggaaactcatgaagtttccataaattcaactagtaaactcttatgagtagagagtttacctacctaacttaaaataattaaaaaaatatatgataatattaaaaaaaaaaagagaaactaaaatctatcacaaatcatgatagaaacacagagcaaggatctgcatgcctgtacatccgatcagttatccatccgtagtgttcttaagatgtcacaagactatggttatattacatttcgtgtaatggcatattagagggatataggggtttgtcttgaaagtattccatatcaaagcaaagtagcataatccttattgtttgttcaaagccctctatttagcacatatccttcttccttcaagatgggttgacaaaacagttcttttggtgatgggttcataggcatcgttgtgatagaagacgaatgacacaagttgacaactaacgaaacttcatgcttcgactgagctttgattgggtagcagaaaatggaaaacggtgagggtttcatcaatttgtgtaattgatttgaaccccaataaaacgttacatttacattggcttcagaaaccgtcatgggtatcataaaagtgataaaaccagtaggcgtgcggggattacatttgattttagactcccttctcaactcgagggttcatgctagtttgtactac

SEQ ID NO: 6715 - DNA, 1026 bp, Glycine max
  Soy_ogl_2878 Gm08:43770475..43771500 Cluster 30
gagagagagagagagagaaaccgaaataataataaaaaacaataaagagataacactggtagagataaattttccatgcataaggaaagtgctttagtatcacatctgcatgtatttttcagggagttgggtttcgacatatgtgggtttgatttttaatttttctggttgttatgtaagtgggacaccatttatttgtttgtgcatgggtattgtaacgaaatgggggtgagtttaatggaagtcactgttagccttttgtgcagtttgcttattgatgggcatctatgtattggggttatactttatttatgccatttcaatatattgcattaataatgtgtaacctctatttcagatgggtgatccttcaatatttatatattacacttgggatctctagtgccgtatttatttatataaatacatatatttgcagaccaaaaaaaaatcgcatctgtattttgtaccaagtggcacaatgatacaaaggtatgcatataatatgatcgatgagagatcggatcaattataataattaataatgaaaattacaacccaaaagtttacgcaacagtggcatttggaaatatgcgtgcattacaacttggcaacttgactttttagtctatatatgagcattcttccagattgcaagaacactgtttctaacactacaatgttcagaaaaattaaatattttatttcagatgattgagtgcatatattaaccatttgtattcgagaaacacaattttcttcggctaaaaaacaaaattgacttttctggttcaagaaaaacgacaaatgggagacaaaattggaactggcatcctccccagcagcgttttgtctccagccttctcctactcttttgcaagccattggatgaattaatcgaatggttaaggttgaattaaagatacaagattttgagtataacattctctccggcatgtttaggagaaacatcgaactatggtcgtgcagttttataagtttaattagttgattaatttaaaataa

SEQ ID NO: 6716 - DNA, 1200 bp, Glycine max
  Soy_ogl_1504 Gm04:48922201..48923400 Cluster 30
aaaaaaggtgtgaaatgaaagcaagaagtgtcaaattatcacaaccgttatacatttatgtatttctgtcttcattgttaattacttcagaaaaaacactattggtttagtcattgttgtatggcgtcccgttgccgtggcgatatatatataaacaatttagaaagaaaaaacaagagattatatattctcgggattataagtttaattttgtcaacttaaggtaagtacacagtttcgctgcatgccctcatatttctcttcacttgtttttagctgtttcaattgtcaacgatgacataaacccataatgggagacattcaacaatattgtgatgcattgctactagaaattggaagcacaaactatgaattcatcatttcttgtttaaagcactttatctaccccattcctagagatatacatattcaatattccaatttgaaaattttcgcaccagttagctgatcatatttgtccattaattatatactattcaattattcatactatggcctgatgttgttgacttgaacaattcttcagcttcacaaatcattagttaaatatatgatcatcatctcttttttgggggatttatttatacgcatttcgctttcacagtgtggaatgctgacttcgtattcccaaccatatatagttccttatgacaggcctttaattcaaatattgcgtttggtatagaaattgactgataaggaaagcaaggagaatgaaaaattagttttttgtttgatgtgaagggagagagagagtaaaattaggagaaatgaataatatgtgggatcttataatttcccatccgatgattaagaaggaataagaaaaaggataaatgatagctctttcacttttttctactatattccttcttctttatgcttttatcttaccaaacaaaacctaatgggtttgcacaaattttacagagtttggcattcgcgggaagcatcaaattgacccaagtccaaactagacaaacggccgtcctatcaatggaacagtgacccccaccaactgccctgtattatgttattgttacgttatgatcaatctttgtaggagttatttttatgtgcacaatgcaagttccttcttataatttctttttcatgcatagagcaaaacgttgttataattttcttgcaagaggaatgctcttagaccatttccaacta

SEQ ID NO: 6717 - DNA, 1300 bp, Glycine max
  Soy_ogl_4878 Gm15:2785001..2786300 Cluster 30
cactcctctattaatatactcgcgcatcgttccctatgcttgcgtataacataaacacctgttgcagaatttcagactgaacttccaacgggcacaacaacacccgccaaacaaaaaaaaagaaaaatggaaaaatcatacttcatccaaggctcagaagttcacaacaagttttacaaatttcttagtcaactaaaaccatgcttgcacaaactttgttaacacactatatgagcgagagaattcttttgcacatatgccaacacccaaaagaatttgtaaacgaaagaagaagtctgcaattgcccttaaacgaaacttgtacccccaataaactagcatatacgactccctcttatagcctaattatatatgcacaacaacacgacctgcatctactgaacaacatttctgttaagtgtaacgagaagtgaagtgggaagagtcccgaaatggtgacgatggagttgatgatgaggcagcgaacggattgctccacaatgtgaagggaagaagagttgaggcagtgagaaatggtgtgttttttggatcaagttatttgagcattgatcgaagcttcgagatatggaggaactaataccctaattccaatacaaatttccagaacggttaacaagggagtgtgttcttcaagggaggacatttttggaaaagaaatttaaaaggagcgtgtcttaagcaaagagggggaatggaaataacaactcctcattttattttattttgcttatggatataggagtatttgttaaaggatcttgttaattacattatttaagaaattaaaagtcaaaagtttttaatgcgtaaataggagagtgaaaaaaaaaatataattttacatctatcagtaaaaaaaactttttactctttgttctttgactagtatccttgagacacttttagaacatatttgatttcctctttacatagttaaaacttgagttttaaatcagtcaaatttaatttttcattgatcatcgtgtttgccaatcagtcataaacttgatttgggtggcccaaactcaagtcaagttgaagctatttctgataacttctgcatccactccaacaaaaactatatatgaatattaaaactcattttgataattatacatctaaaattaattttgattgtaagtttcttaacaactttatgtgtgaaaatcaatttttttaatatttatcattcaaacaaaaattactttagaacaaattcacatttattaaattaaatatgttcattctaaattaattttataaatgcatattcaaacac

SEQ ID NO: 6718 - DNA, 1000 bp, Glycine max
  Soy_ogl_1502 Gm04:48891501..48892500 Cluster 30
atggcttcacctattagtaaaccctatgtcgttcaaagataagatggagaaatctttacacctaatcattaaagatttcctggaaacagagccaaaaaaacctatgtcactggtgtttcaaccaccatttgtttaaatggtgcattagatgtttccacctatacctcaaccaaaggatatggaggttcagaatcccccaacaaattcattttattggggctcaaattcttgatattcatagtcattttgatgccaaagtttttcatgcattcaacttatatagttttcttttgtgtgtgtaatacgtttatccatattgcttagtcatgtattgccaaaaccctaccatattgaactttctttttgcttttgttgatcatgtgtttgactatagaaagggacaaaataataactttaggggtatcattaattatcactaattccatttttttcttaatcctaatccatttggtttttgttgcagcacctttatcattattcgagaatgattataagagccctattagacgtaattaaggcattgtatttattgccatccttaatcggtttctctttattgcgttcttcgtcaatgcctcttttattcactctactttcatttgacgtttcccttcagaaaccaccaatcagtcaccagctgacaaatcaactacgtagccaccaaaccagccttagggtttgcatggctagtactttcgttttttagttgacatccttcagtcatagaattgcatgtgctcagttgtcgtcacctattgcaccgccatatgctttgcacaactcctcattgtatggccatagaaaccacacttcttgcgaagcaagtgccaacattcatagcgtgtttagataacacacaaaaaattaattttactccataaaatcattgtgacaccatgaaaaaatagaaataactatttgttgctttgtcttcaccatgaaaatttaattaattatttcccaccatgaatataattca

SEQ ID NO: 6719 - DNA, 1400 bp, Glycine max
  Soy_ogl_2604 Gm08:11401..11104300 Cluster 30
agcacgtgacggcccagagggtccaaaaccaaaactagggttcatgccgggccacagcaaggttcatttgggaccactcactttttccaataatggggccttttgttttgtttttgtatgcatccacgcgtttcgattagaagaaggaaatgtgacccactggcccctaccctaaaacccgggtctggaacatggtcacactcgttctagtgattctaatttctaacctcaacaattttgttactcatttggttcattttcacttttcaggggtaacaagagttcatttcctttgcttggatttttttggcttcgagattgtcattttgtgcctgacagcaactgaagtatattgttactagctacaaactatattatagtaaagcttacattgaacggtacgtttccgtcgtagaacgaactatacggtaaaacgcatggagttatgatgaaagttttaaattctagtcacgattacgcttgtgatttcattgttatatttgatattgcagaaaattgtgaggaaatgtagataatgcaaccactattatggatgtgatgtgtaaaaaaaaaacaatacttaatattgcagttaaaattgttgtcgcgcaacatttttgaaaagcttaggcctgtttattttgaaaagctattttcattttaattactgagagtgaagatgtttattaatactttaattataaattttgaatttactaaaatataaataaaaattcataaatgtaggcaattccgagtaaatatttctaaatcattttcccgtccaggtagaggtgggtatgcactatgaagtggtgttttatgaggataggattactagaggtgcaagtttaaaagtattattgcatgcacgatacgtttctttttgttttcgatcttcttttttgaatttggttctcattgaagtgattgtatgatatatagtttcattgttatatttgatattgcagaaaattgtgagaaaattgcttgcgtacgtatatttcttaatttatttattaatatattcctaatctttcttttccaccggtgatatctctaatcttaatcatcagcgggaaaattagatcagtatttaattttatgtatgagcaataaagggacagtgcagccccacaattagatattgatcacagacaacagtgttcaacggatgattgaggccccatcaatgtcggtcatctattttcattcactaatgcatgattaagaagaataatacatatgaagatagaatagttaaatatgaggtgcacaaactgaatgtaacgtacgtactcttcctaaggtattgctagctgctactcacggacgcatgtcgaccactctatatagtagtagccttcttggggaagacccatgtgcatgaaaggtagagc

SEQ ID NO: 6720 - DNA, 1200 bp, Glycine max
  Soy_ogl_2924 Gm09:970101..971300 Cluster 30
ttaattaatctcattgaaaatttcaccaagcccacctagtaatcgaccaatctcacatttgtaattgatgaatctcaaaactatattaaccaattcatgaattaaattaattatttattcttttattagattgattcatttgaaccattaaataaaatatatgccaacaatctgacagggaaatgacaaaagagaattaggatctgaactaattttcacagcgtagcatgtagggtaatgctgaatcggtatctgaatttaagaatagtctacgaatacgacatccttagttaaaaaaattgttccaaagggcatacatactttattaaaaattaacttggccaagttacaatgaagtaaagcctatatatccataaccttaaggagttatttgaataaagtaagataaggttttgtagatgataaattacaggttcaaactttcatttgtatttttgaagtgagataaatacaatttgcgaggtacagtggtatatataaatgttctttaaatctcgaggtttttcttaccttgaattggaatgccattaagaaaagcactaaatcgatgatagaatgtgtttataatttttgtaatcatactttaaatgataaataaaccgttatataaaaagtattgcaaaactcaaatctatattaaagtattaaaggcagttgaccttttcacaaatttggaacccaattaagaaaggacaagatggtggggaatgcaaggtggtaggttccacaccctttactacattgagggcagggaaagataaggcatgaagaagataaggtttggtgtattgtaggtagaaatagtatagttgctgtcaacaacaccttcattttcatccacaaaagggtcagtggtatatattgcacaagtttaatgtgacactgagaagccgaagaagatgaaaaaccttgctttgataagagtactttctcacattcttaggttctccaatgatcaatccatctctttctgctctattcatttcccaaatccattaaagtaccaggaatagtctgggatatgggaaagaatataattcaaacactagctaacatctaaatttttttccatcagtgtgagtgatgaaaattttcaactgtggagtctggcacttaaaaaatgggaattcaaggcttgataacccttgctttcttgggtcctggcttccaagggcccag

SEQ ID NO: 6721 - DNA, 1021 bp, Glycine max
  Soy_ogl_3822 Gm11:49801..10300821 Cluster 30
gactcaattttataatcttattggataaatctccaaataaatattttgaagtactaaaaaaatgttaagtttcatgttgactaaagacaatgtcaatataagtaagaaataatatttcatgagctgactttgtgaaattaagttaaacttaaattcaaggcagcatctagagtaggagaactttccaaatgccccaccttacaaaagtaatgtgatatgtgtgatttggactttttttgagatgcatgagggaatcctgtggacatgtctacactagagtaaattaaaaaaaataatgttcaagagaagtggcgaaggtggtgcaaagtctcaacacattggtatggagatggagatgggtgggagatccatagactccaaagggacatggtgctctttgtgttttttaatttactccagtataagcatgttcatggtggtactctcttgcatatctcgaaaaaagtccaaatcagacgttacacattactttcgcacggtgggagatttggaaagctcccccaccatagacgatggagagagagagagagagatggggtaaatctggaaaagagttgtggttggatgacaacaagtgtatgagtaacaggaagatggagagagatgaaataaatccaaaaaagagaaagaaaaaaaacaaaaacaatcttaaccactgatttaaaaaattaataaatctaacagatgacattattttctcacggtgggagacttattgttaacttatgtctagtttgattgcaatcttcaaagaatatatcaacatcccaagcgcgttaagtaagggattactagtaggaaataatctcggatcaaagaagaattattaagtagttctgaatcacatgattcctaataatctccacatggcatgttattattttaaaaaaataatctaaaatacatgtaatgtagaaattgattgggagtttgggaccatgaccaaatggtgattctcgaccaccaaataatttctccaggcaaaggtgatatccctgca

SEQ ID NO: 6722 - DNA, 1100 bp, Glycine max
  Soy_ogl_4004 Gm12:5015701..5016800 Cluster 30
tctaagagaagccgccatgagaataccaagactttagagggagctagcgtagcatttcctaaaattgttatgaaaattatatgcctgttgattggcatccgaagagatcctgtgttgtagtagtattccatatgttgatgatattgtaaatcatttatcagagtttgcattccatacccaatgatcctatttgttatgacagaattgaatccattgtaaaagtgagagaaggtgctctagtgattgttgttcccattggaagaatggtcttctccaattccacgaccatcccatgccttgttctactgaataacagacttgcaaaataagagcatccttgttatctatgatttggaacaaacaaggaaatgattccttcaaggtaaaattatccagccaccgaatactccataatccagtgttgtttccatccccaaccacttttgttagatgctccttgaaccaatctgttgggccagtaggagaagattcaatactcaccgagtctctccaccaaattgacgagaatcaacgatttgtaaggaatcatgggtagaaatattatcatatttaaaatgtagcaagttgtaccaaatggccgagggttttgttaggatttgccatttccattttgcaaggaggctcaagttgaagaggtgaagacctttcacacccaatcccccttggccttttggaatacatatcagattccatgctacccaagaaatcttttgagcttctgttcatccctgccaaagaaacttagtcaacaaagatatcaccttttttggagctttgtaaaaggagaagtataagggtaaactacccatcgtcgaatttatcgaaaccaatctccccccaatagataatctctttttgaacctctcgataacaggcctccacgtgttgtacaaacgtgggttggctccaataggaactcctagaaacttaaaaggtaaggcaacaacattgcagtggaggaaggatttcgccgccatcaagaaaggtctatcgatattaaccctaatgatgttactcttatgataattgacttccaaacttctgactatggctttcaaggccgataggttgtccatcgt

SEQ ID NO: 6723 - DNA, 1000 bp, Glycine max
  Soy_ogl_4852 Gm15:1416801..1417800 Cluster 30
actattgcaaataattttatcatatgagtgcgttggaataatttccactgtaaatagttgagattactaaaaatatatatagcttggtttctaaagtgtaaatttaccttaattaaaataatttggtatcacgaagcaaactcttgtgctacttttatgtgggcccatttttgccaccaatcttaattacaaatttgaaaaggacaacggaaaaataacgggcggcagtagttggtgatttggtggtcttgattgcttgcttatctgtcatctgtaacagtcatgtaactctaattaattaagccttactaatacagtgcaaataaataagtgaaacggaaaaaaatctccttccattgaaaaaattccgtacgtacggttccttgtgaaagtaagagaattaattaattaattaatcgtgttcatcttacgatcttgctgggataagtaagataagaaaaccatttaagtatagtatatgattactagcacttaagcatagtatatgaataatagatacgggtcaagcaatgtactgtccaaatctgtgtcgtgtgtcatttggtagtctcaggagagtcctgtatgtagcttatggttttgcatttataccaaagtacactaaaatgaatccatactttgtggttaagatagttcagtcgctgtttaaactttaaagtttagctgtttattactgaggcttggacccgttgcttcttgttcatttgttaattaatttatactttagtagcaagattagcttaattaattaactgtccgtgtcttccacactattaactcaccattatttttaatcttgcatatcttcctccatcttcttggttgtttattgttctagctagccaaattaacgaaggaagaattcggttgaaattaagtaattttaatttaacttaattacacttttggtttatgattatacttaaaattctctggattttttttattactgagttgtcaattttctaactcttttttt

SEQ ID NO: 6724 - DNA, 1200 bp, Glycine max
  Soy_ogl_5435 Gm17:787001..788200 Cluster 30
atgctctaagaagttctaaagttactgtcttaacttgaaatgcacctaggaagttgtttgtctgagatcaattcgtaagagctacctgcaatggaacagttccataggcactcaaccagaaagataattcgataaggcattaaaggtaatccagactataaatgactgttagagaggtgaagtgtttgcaaaattttggatttaccaaacaaatatggaatatgtatggcctatagaggatgactaaggatttagatggctttcgacagctgtgaaatactcttatgagatggtatttacatttattatacttaaatagttttaattcttattgaaaaaaaatatttattaaaaacaaactttgctttattttttaactagccattattattttatgcaaaaaaagtataaaacactttaaagacttttttttgtttaaatttaaaaataatcttaatgtacaatttcttaatttttcatcctataatttttgggcaaaatttttaatttgcatcattgtacattttttaaataatattttgtttaaaaatctaacatcattacatgatgtttttgtaaaaaaaaaaattaaaaaataataattgaggagtgactcataatttttaagctccgccattctcaaatttgtcatacatattattgctttactactattttctccttcagccaaatcaacggtgacaaagcttatgaacaatgatgttgagaaaggttttacaagcattggaaactttatccttacaatgtctgttaatccaagtatgaacttgagtggagaatagtagcattgacgaacatactggttgtcacaaatgcatgcatatataggtcaaatttcttggtcgtgtgctctaattctttgtcaacatattcaactcaactgtaatgtatagtgagtaattttagcagctttggccgggaggtaggcagattaatggtccttcactcctcgtgcatgatcccaattgatcattttatcactagatgaaattgtccatgcaccttttattaaatcagactaaacattgaaaccatagtctattgttagttcttgaatcaactaaattgacctacttttttccaactcttatcgtgatgctgttggaagccattcggggttgattttgcaaatccaacgattatgctttcctacctactttggattcttaatattatcaa

SEQ ID NO: 6725 - DNA, 1300 bp, Glycine max
  Soy_ogl_5541 Gm17:6057101..6058400 Cluster 30
caaaaatggggaccgtacgttaattagtagaggtttgccagtgctcatggttttgtggataaacattattggcagtagtggcgtgcgtgacaaaagctaaaaggatttaggtcttatatttgttgcatggatatgatatctcttttactttaacaggttccttccatgccagtactgtctacaacttgacacaaaggaatccactatatatacaactagttcaataattgttatatatgcatgaaagccataaattaatagtcgagtactatatatcgagtctaacgtgagctagccaccgttttatataatatggactatggtgcatgagtgcacaaatattatatttcttaactattgggtatctattaaagttaaaagcttaattattggtcgagtctatcctgagccaccgtttatatgatgttgacgatgattatgttctggctgttgtggcccttttagaaattgttagcttatttttgcatttgagaattaggagtgttttggattttttgataggcttcatataaaaatggtactccttggattctgtttttggatgctgatattgagcgggtggtctgatgtgatttttgtgggcgccattttccttttcctttgagattcaactcttactttaattggatgttgcattgcatacaaaatccttgtgtggttcacaacgtagcagccaaattgaaaagaaacggcacagtcagaccaatttcatttaccactactattattaaatgttgattagatgagtaatcatgaggtcatagtggataatgagccaaattaattgcactaaagaggcatcgtgtttggcctatacttgtcagagacagaaacatgcaactttatttaataaattgaagttaagtttctcaagccaatttcaccgaggtcccccgtggtaattttattttattttctaacatttgtgctggtgatttgccattttaatattttttttgttatgcccatttttgttgctatttgttctagaaagattacattcccaaagatcatttaactatgaagccaaagattagtctccagagctgtttaccataacatcctaaactattttgatagttattgtcaacctaataatgcagatcttgagaataacaaattcccccaacaattcccaagaattaagcacttccaaattagttgaagattatgagccactaacaaccatgacagagcacgtatcagtcatcaaagaacaaacactggttaattttgtgtgaatcgctcatgggtctccttgccatggtatcctgttgat

SEQ ID NO: 6726 - DNA, 1000 bp, Glycine max
  Soy_ogl_6218 Gm18:56858601..532600 Cluster 30
ctataacaagttatgaaatttgtaagttagtctctggttaaaagtaacactcgtggttaatttgcaaattttttatttgaaaaattggggttctccacttttctatctctccctttcccaacgcttcaccagacccattacaatatttgacatcaaatctccaattaaatttcctatgttgatatagtttggtcccaaaatggattaattccaataattacatgcagaaccacactatcatgatgaatccaagaacccaacgaagcaaataataaaggcagtgaatgatctggcactgtgtattcatatgcaagaatgccaaacgtgcatccaagatgaagagaaacataaacaaaaaggaattctaagattgtatacaaattggtaagtgtgtaaacaagagtttggttgaagtggccataggttgtcacaaccatacaagcatagtgaacatttcaaaaacagaaccgagtgactcctcctcttcttgagatttgccacgacggtgctagagaaaggtgtcctaggcaaaccatcaaagacttggtgggcatggagtaatgttatggcaaaatggcacaatctaaactacaagaacacgaacactaacccaaacatagaaaaccccaattttcaaaacaaacaactaatgaaggtatgaacaagcaacttgaaatagaagggttttttttttttttgcatgaaattaagaaatcaagggaagaaacaaagaaaggagaaggaggtttgaagctgagaaaggagaaggagattaacattgaactgttgatgaagatgagatcattttgcaatttttgaaaattttattaatactgtgacaagccggtaaactccatgtttaccttctattgccggtatattttcatggtgcaggtggagcatatgatttcaaagtccaccatggactttaccctttagttatgaaccactaattcatagttggggccctttttccaaagggaatttccaatgggagaag

SEQ ID NO: 6727 - DNA, 1200 bp, Glycine max
  Soy_ogl_6624 Gm19:49388301..49389500 Cluster 30
aaagtaatagtacttggactgttggacatgcaaggagacctgattcaatatagtattacccaatcaaagccatatgaagtgtcttgctttcactttgaccatacccacaagcctagttaatgaagcttcagtcttttcaactgtgatctttgttgctccgtttgccgttttggtctcctcatcttccgctggtgttggatcttgtattataacttctttgggcttttactctgtcttcgaattatctatcaccacttccttggtctccacatgaataaccgggagctcagcttgtggggcatcaattgttgctgcttctatcggttcttgtgctgtttcttcctttggtttttcgattgctgctggttctggggctggaacatcaatgcctgattgttctgtttctgggattagtcttggtcgttacctcgttgttacttgtttcactttggttcaattttgttgggacttgtgcatcctgcaagatccaatttcaattcaaaaagcaaattcatgactaagttaggtgataaaatggcacgtcacataatcaaatctggcaacttaattagagaaaaatgtggattggatcaataggcatagcccaggatgagaaactaaagaatattgaatccttgaacttgaagtggcagctaatcagaactgatttatttcttttgtttctaataaaagtagaagttcatataatccaccactggatatatactatgtgatctgtaaaattaactggaaaatgacttgtgcttcacaactagatagggtcagaactcagaaggcatgaaactccgccactctgtctctattatatatataccctgaattgcaagaagcgaatttatgaccaacgatgattcatacgacgcgaaattgtgtattacgtattgtatattgatgatttggatacgtagatctaatataatacagtggtacttaacaagaacattatgatatgtaaatttgatcggctgatcaagctcagagtagaatgaatctcccaacaagaataataatttatcacatagattcaatcgcatatatactgcgtagactaatatgaagtagtagtgtaatcttgactttgagttacctgaacactggccattgagacaatgcaaataattgtaaggaactgagactaaagcgagaaatgggcattagcagtaagctagctagctaggc

SEQ ID NO: 6728 - DNA, 1100 bp, Glycine max
  Soy_ogl_1791 Gm06:5229901..5231000 Cluster 30
atgtaaaaaatgttataaatctaaatttgttcatgtattttttacttattagcttactctttttaactatcagtattgacaagagaaatctcttaaacatgtggtatttaagtttaattttaaaataaatttcattaactgttatcttaaaaatggttaaggaattaatagataaataaatattaaaaagtgtgacatttaatgtattgataacattaaaaattttctctttctttctctgcacatcacttaaatcttttattgtttttttaatgtttcttccttttcttttttctttctattcctctcttcattatacccatccaccccaaacatttcctctcaattaaaaaactcgtttatattgaattccttcagaatgattaataaaaagaaaaacattttaagattattttgtacttctgtaaaacaaaaattctttcgtaccaaaaaaatatgattaatttttcatttattagatgagagaatactgtaggaaactaaaaaaatattcctaactttataagataactgattcatgataaattatcaaagtctctataattgaaaaaagttaacaagtataagtatcaagtagtagcatgtactattaacgcataaaatttgggtgtctcgtgatatactgtctgtccctgttgacctttatttgtgtatttttggtggttggtgggaggtttcgtacgtctgatcccacagttgtgagagtctgtgtgcttaaccacaaatattatgtgtgccttaattggttgtaacctttttcagtctcaattcaattaatcaacaacttcgtgttccaagtggtcctgattcctgaataactgttgagtgtctacgcaatacaaattctttgtcagaaatgcaatgcatgtatcttatttattaacaccatatccatcacacaaggtcccagtcacacaaccaaaagctaaataaataaataaaatattgagaggactcatcatttcctctgacatcaaatttaaggcttgagaggacatattctggctatatttcatatttcttgtatgagggaggctagagttagatgggaaagtaaaacttatttaattggtaccata

SEQ ID NO: 6729 - DNA, 1358 bp, Glycine max
  Soy_ogl_5558 Gm17:7038343..7039700 Cluster 30
ataaagaaaagggggactttatctgaatgttaatgttaataatcagagaggtaatatggcttcacatgttaacgtttgagagactgaaaattttttgtatcaatttttcatggacagtttttggagaacagatgagcagaatgaaagtaacctcatatagccaccaaaccaaactgctcatttcttagttcagtgattacttaatctaacatttgccatgctgaaaatgatgtaattttggattaacacgtcttgtatagacttaaagacagctagaaaaatatatattaaataaatgaataaacactatataaagtacaaacaaatgattcgacccttacccataccagaaaatgaaccagctatgcaattttttgtctgactgtcaaatgagagtcatgtgacactttggatttgcccaagttcgaagcagcaacaacagttagttctttgcattctttttgtgaagtcagaatatttttcagctgaaagttagacactaatatctcaaggtagtgagatttatttaaagggtgaatctctcctaatagctactcttttatacataggcttagaaatcgaactgcagatcatataattaagatatctggcaatcatgtcacaacatgttgatattagttggttgcattgctcctaatcaaagctgtccaatttgtattccaaagccacccaaccataagattcttccctcgcatttcaaactctggttcagctcttactaaacatgaaggagtgatctatcacaacaaccacaacatctccaagacccggtcggcatcatccctggggtctcctcttcccagcagtagccaggacaaaactgaactgtcactgtcctattcatgtggtcacacaatcaaaggctccaaagtctcagtcactccaatattaacaaatttgtctaaggcggtttgatttgcatagaaattttttccaaagttggcaagttctctaaaaaagataaggtttagatttttatccctaaaaaaataacgtttagatttacaagttgtagttacaggtatgaaatgaatttaccttaagcacgattcaaggggaaggagggaaagagaaaaatcctttgttttgatttgtataaggagtagacaaaatataaaactaaaacatatttttcgtctcatatttatttaacatcttaattttgttttttaacttcttttctttttatcaaatttttaaaactttttttggtggcatttttaacttatttttagttacaacatttttttgagaaaacgggctaggttaaaatgttttacaaagtcatcaaatcaaaactaattatgtataataaatttattaatttttaaaataat

SEQ ID NO: 6730 - DNA, 1058 bp, Glycine max
  Soy_ogl_5975 Gm18:7150943..7152000 Cluster 30
tgacataaattgttgtacaacatctacaacttgttttacatgacccttaaatatttatcttatataatgaggttgataatacttataagggttgaattcttcgtcgctcttgagattaataaattgcctattttggtaaaacgatagagtgacttttttcatagagtaactttatttttttattattcattacatatcttaagcacgtatatttgaatgttaacttcactcaagacattaaactctgggccaaagcatcttaaaccaggaaaacccatcatgtgggtgagcgcagtaagcccaatttataatatgaactaaaaacaaaaaacaaaatacactcctatggttttctgaatgtgtattgtgaaattgtacttatatatatatcattgtaagaagtaaattacgtagatgagaggtttaaccattaccctaccaaatcaaccccacaatatatactatatttgatgaggtctgtaagagcaagacgtataaaattcagtagcgcacgttgaggcacataaacgggggaaacagtgcagcattgacatttgacacagcacatgaccactcattgagttgtcaaattggtttggtttagtatagtcagcaatgatgtatgtggcaagtggtaacctcatgcatcatggtcgtggtggtgttagttcatgttgttgtggtggattcaagtcgtaagcatgactacattgaaagaaaaaaatacagcttaattaagtgttattgaagtacttgtcatatataagttcttctcatttaagtgtgtacaaaaaagtttatattataaataaggttaaactttttattgaaaaaaaattgatagaattgagaactactcgtaatattattaattgggcaataatgatatgataggattgtggacagaatcttatttagagatgacctaaatcacaaacaatttgtgagatttttctaaaattttacttttataaaaatatgtctattagagattgtatcattttatggaaatgtgtcttcttttatgaatggatatgtttcttagaagaattgtcata

SEQ ID NO: 6731 - DNA, 1104 bp, Glycine max
  Soy_ogl_1038 Gm03:42174142..42175245 Cluster 30
catttatctcaccaatttgttggtggtttaaaaacatcatttggaccattttccacaaagtttctcccaccacctcccattggctttgatagaatactgcctgaaatccatccggaacgggagctttgaatgctcccatgcttctgacagtattatatacttcctgaaaagtgacaggagcaccgagagcagacagagaatgactatttagagtgggaaacatacctgatacaacataaggcacataatcatcactttctgcaaataaacttttatagaatccagtcgccagattttttagttgttctgggtcagaaatccatacatcgtcctcatcctggattatatcaactctacttcttctcctgattacagttgtcccatggaaataactagaatttgtgtccctaaaagctagccatttagaacgagctttctggaaccaaaacacctcttcttgaatcaaaacctcctcatatttactccacacctcctgcatcttatcaactaggtaattggaatgaacaaaactcatccttctatttagttgatctagtttacacatcaacctcttattcttcacaaaaatatttccgaacacctccttattccatctttgtaggtcgttctggattttcaccataagctccttccaaggaattaagtggttccactgagttctaacaaacttctggaactcagcatgagatctaacgttttggcattggtctctttttttctgatccttgacactcccattcttagaaataggaggaggaggtatctccttatcagggcgaaaggtgaaaaaggaatagcaccttcatggaccagtagcttttccttataccaaaccttattcccttcatcctcctttccatcgtcatcgttcatctccaccatctcttcagctccatccccatttgattttcgttttactttctagtacttcgtaagaagctcatcttcttttttccaagtttcttccggaaccctttacaagataggtaactaaatatttattgtattgtgtaaaagtatatatactttttattattatataatattttaactaaaggaataatacctgtacaaaaagtaatg

SEQ ID NO: 6732 - DNA, 1057 bp, Glycine max
  Soy_ogl_1234 Gm04:5462444..5463500 Cluster 30
taacggatcctgttcaaaagtcaaaactactagtattgtagtctcaacaggacaaatgcaacatgggtttggtttttttttcttcaatacaatgaagacaataaagtttaaatctaaaactttgtgtaaactatctaacctcctatgccgacactattgaattaatatgggcctcttcttgtgataaacaatagtataggataatctgcttttgttaggatgtgaatggatgtgagaaacaagcgaaaataagtttttgcctagttctcaaacaaggttgaatcacattgaatgccataaagatcaaattcatttgggtcttattattaaacctagttaaggaatcaataaactaaaggttattactaaaaatcatgagcaagctgaactataatgtatcaccatctctgaagtctgaagtgtgaaataactcgaattgtgtataatcctcacctggctcaccatattttgatacttccagcttccagtgcaattgaggagattcaggtaccctgtcatgtatttttaaggacccacttcgctcactggtatagatatttatagctgactatgattttaatttaacacgactgtgttatagatattagtagttgaattgctttggaagttagtgtgagttaaatgattaatcatagctatttgaagttaattgatagatgttgacaggattatgcttatttacattgttttcctcatttttcaatcaacagcaattctatatttttccttattttcaagtctctttgactctatcatatttctcgaaatgctgttaagtttttttttgctaaaataggaagttaatagatgaaacaagaaaaattaaatgacacactgatatcttcctctgatttcttggtcaagtgttgaataattttgtcttagttgactgcgagtttgttccttaacatccctttctaagttcaaaagtttagtgaaatttggttgttagtaaattcaaaaacaaccgttttgaacaccgttttatcttctgttgaaattttgttgaatattccccaagtagtttcagttgaca

SEQ ID NO: 6733 - DNA, 1046 bp, Glycine max
  Soy_ogl_4418 Gm13:33018155..33019200 Cluster 30
gagtgaatttaaaaggttaatatactttgtctatcattttccaacaaagcaccagtggtctagtggtagaatagtaccctgccacggtacagacccgggttcgattcccggctggtgcaattttacttttttgtcattttttgtatttttatccaatgttgtctctttagatttagaaagacaaaaaaaaaaaaaaaaacccggtttcgaatatttgcattttatgtatgaatgggtcatataatttaatctaatgttttatttggcagtcatctttgttggtcacaaaccacccaataaaaatcttccaattttgaagaaattgttattttgtgtgcagattaagcttaagttggccaaattaaacacgtatatcaaaaagaaaaatcgggaagaactacaaagaaagcagaaggaaatttcctgaattgtttgaatgactcgtggatcatttgaccattgcattagccaagcacttaaaaaagatacatagcagatcagcaagccttgaatgatacttggaccacgtggtggactattaagaagttcaaactaaccgtagtatagaagaaccttcgtgaattgggcttagaagttagaaacaatgaaaagtgtcacatgatgggggtcttaggacttataataatccaaaaaggctcctgcctccaaattatggaatatgcacattgcaggattgcacgcagagcttgcccttgtggtgggtcttttacactttttctttttttttttttgtctttctcagtctcaagagccatcattggataaaattgcaaccaagagccatcaatgtcatcaacctatcaacttcttttatccctttggtggcactgcacttggtgcttgttgtgcaaaacctttccacctttttaaactcaagatttttcattagtggggcgcccattttgactcctacattcttcattatgcatccgtgtgaggacaaatctctaaatggtatatccccaacttgagtctcccacgtgtgatgacaaatccctgttcaggttttgccgtgatatgaaatt

SEQ ID NO: 6734 - DNA, 1000 bp, Glycine max
  Soy_ogl_4787 Gm14:46413601..46414600 Cluster 30
tttcagatttcacttcattcattcctcaataggatgcaaaccttacattatataattttcttaatggataacaaccatatacatatgtcaccatcttagtattttagaaaattaaaataaaaccaaataatatcaaaaggataacatctaaattatctattctataaaagtcctctatttggacctcctaggcccatccatcctttcataatggagctgatcctggtggatatgaaggactttctgatggtgatatatgatgagaaaggctcaaaatctggtggtaatgaaaaagggaaatgtgatgctgattgtttaagtgtcccttggttattaacacccccttggattctgggtgtattagcagcatttgctaccttgaggaagttgcctcctgtatgatctatccccatgtgcctgagacaagattgacacaagcaaataatttctctaatctgtagattctctaatttcttttcccaactaatttgctttatcaaaatgacaagtattttgcagtgtcttgttgaaaatgaaataacgagataattaatattaattctatatattaccactttattgctacaattagtgacatgcatattgtatgtgataaaagcaagggtgcgggggaaagcagaaaacaatgacgttctgtattgaattttttaaatataggaaacttgtcatagtccatgcaaactaaatatgtaaaggagaatgatactgtcacacatctaaattccttcccataatttcatttcaaataatatatggcttagatatagttcattcttttacaccaagtcgaaattgaacgtttttaaagtcagttcgtacgtacgtcgatccctcaatatcaataattaattagtgaagttaaaatttgtttaagtagttacgaaatggaatttctctgattggtcaatgatgaaactcaaaaagatataagatgcggataactgtgaagttgaattaattctcaataaaccttaaacat

SEQ ID NO: 6735 - DNA, 1033 bp, Glycine max
  Soy_ogl_6282 Gm18:59668352..59669384 Cluster 30
ttaaaatgttataagtcatgcgaatgcatcatttttttgtatgcttccagggaaaaaatacaaaaagagcctacccaagaacatctctaaaaaggagagtggttagggcaggagaaggagaatcaactgtacgtacaaagaggttgaaactgcctaataccaaaactggttaaggtgtgcgcaatacctccctatcaatatggataaaggaaatagtccagtctcttttgataagctccaaagctgaggacaacttcctgagctgaaaatatcaaccagaaattcaacatccatctcgcaacaaagagggtgtaagcctttatcctaagcaagagaaggccatggataaaagttaaaatctcagccttggtactatccccagaaccatcatcagagaaaaattaaattttatttattaaattatgttttttttcttgagccgaatttctgactccgcttcccgtagttatctttcttttccttgtactctaatttgaccacaaaaacccacgccatatcaaatatgtcaccacaactattcacttcaattcatggggctgtcttcgtggtatttccaaggacttttagactcctcctaaatagttgttgatgcttctcctcggtgattttacaatttattcagatggagtaatcatctcatctgggctccaaagaagcatgcacatagagaggataataaaaatgcatcgcttctgggatgccaccgtcggagttgcgaggatgccaatggtgtatcaagtcaaaactcactggtccactataaactacttgacaaagtggggcactacagaacttgacataaagcataaccaacttttagaggtgaagacaaacctcgatgattattgagattcacaagcatgtgcacataactcctattgcgttcacatgttcagtacctttatgaaaatatgactaagactttgttgagagaataaaaaaaatatttaagcagtttatcttattattttgttttgttttaagcagtatttttaagggcactaattaaaag

SEQ ID NO: 6736 - DNA, 1100 bp, Glycine max
  Soy_ogl_3961 Gm12:746001..747100 Cluster 30
gccccggatcgagaaaggaaaatcccttgggaaggatgtcttgaatggtcgttctttctgcaatgtcaccttagtgtaaggaagcaaagagagttgatgcaactgtaaagaaattgattaatacagagatcatctaaaacaattagaaatcttaatctatatagtgttattcttagtctgagctatagagtagattcaaatctattatatcacaatagctcatggtgacacactcgtaattttttttttatttcacatagattcagcccctctgaaatgtagacacatgatctttgtgaaaaaaatttctttactcaccaatcattacaaaatctaggaaagggttgtgttgccaatgtctactacactaacaattgcaacaataggaattcctccatccttgtttagattgcttgactgtaattagtcctcaataattttctctttatcagctttccttccatatatctcagattcttcaactaaagaaatcgaaggtggcttctttataacattttctcttatgccaagaatatccttttgttctgctatcttctccagcattccttcacataatggatcaaatgaagtacaaatgttttactttgaaccaccaacgataagcaagacacttgaagaccaacaacctgaagctctctttgacgagtcaagttgccatctttctagaaaacagctcggattcactaattgtttttgatggtttatatgcagcagcagcacaatccccgactccaccataatgcctcattaagccgatcacaatcactcgttgaacctcaaccccgaatttattagcacttacttccagacatgctcgtgcacaataaccgatcaatgttaacaagtaatcatccgttacccgaggaagagtgttactgcccaccaatctttagtgtcttttgagagtttcagaactctaggcaaatgagtgtctaccttcctcgttgagagtggtgaagggttgttgccatggggatcatgactcaatgtgttgagagatcgaagggttgcaacgttacgttggttcttggggagaaattaagaagtatcggtttgatctgaatgtgtatgcgtgtttt

SEQ ID NO: 6737 - DNA, 1100 bp, Glycine max
  Soy_ogl_754 Gm02:50119501..50120600 Cluster 30
gtctacaaattaataaaaaaaaaaactatatttactaattaatattaactaattataatttctatgagggcaattctatatatatgtttcttattaatttattatatattgtttcatttaaaaaacaaaaatgtaaagctcatcaacaacaaactcaaaaaatcaacggcatgctcagcagtccaacatgtatcacactcagatgttacttatttaactttgatttcatatttccttacatgtcatgcttaaaacataacgccgtttattactttgattattcaacattgatacacctaaacttaatcctaaaggaggaaagttgaaaaattcaacttcaacctattgtgcttttacaagtcctaattaattaagaccgtgcttgaattgaaatagagtacatttgacgcagtagtagtaaaacgagcaatcaacatctgctacacgcggtggtttttaattaatatttaaggaaaattagttagctactagaaagtgaaaaccaattgttttcctttgattaatagtttgattactaacacaactacgcaagtcttcggcaaaatactatgatattaatttaaaattaaaccctgcaattgagtctacagaagttgtcacattaaagccaagtaaaaagtaaaaacaatattttatagctagaaagaatactctgcagctaactgctgcttaattcagacttagaagtcaaagggaagatagaaggcaacattcgacaagttaaaagccatatttgacgatataacatagcaacgaaatggcccagaaaagaaattaagccattgggagattaagataggcatggcgcgcccaacatttgcatgcataaagccatgatgagtggctgcacgtaatccagcattcacacttgtacaagaatggttcaaggttttgattcttattttggataaagattcttagaaatttataattcttaaaaatatagtttcaattaatcattacttagtattgacataatgtatatttgaacctatcaaactctaaaataacacatataaatgcatgttacactgtcaaaagcggttttccctctcaaggacattcttgattcttgattg

SEQ ID NO: 6738 - DNA, 1200 bp, Glycine max
  Soy_ogl_1743 Gm06:406601..407800 Cluster 30
cgaaatagacaaaacattaatgactttaaataaattgcattagtccatttcaatcaattcaccttctcttgacccattttcctctttttatatgagattcagagattttgttgttcttgtttcttgtttggttccggtggtcgtaatcaaataatgtataacttaaggatgaatcaactagctaggattgctatctggtttgagcacgtgttggatcagtgacatcaaattacatcatatttaggtggacgttgcatcacccaaatgagggcacttgaaaaagaaaaagcataacatttcttgtagcacatcaattgagcctgttttcaaatgttaagcccaggcctcagtcagttatttttgttttgagttatttaaaaaggcttattttaggtccaaatttagtttaatattttgtccaagtccaaaattaatatttcaagtccattccttaatatattcaaggcatttgctatatccaccccttctctttgtttatccattcccctttttattttgtttttcaaaaatgttctttttaaaaaatacactccccttgtcgaattctttttttttttttatagaaaaagggaaatattattaagaaaacctacagaccaggtgcaggatgggataaaaccatagaaaaacaaattaattgtaaatacactgcatcaatcatatttgtggggaactgtttcagaggctccaactcgcccaactgcccccttcatggaacgaaaaagagagaagggggtggttgagatgaaatacagaggggtacaccaatttcagaaaatgaccaagagtatatttggaaaaatagttacaaaataagcaaaagagaggtgtattattaaaagtgggaggtatatttaacaataaaaaaatcccctctagaactcgcttgaaacatagactacttacgtttgaagtgaaatattttcggaaacatttttttaaataatcatctttacacatgctactagtctattgttaagcgatatatgtgtgccactaaaaccactattaaaaattatttatgccactaaaaccatactttaattataaggactaatatcaaatattcagcataaaaggcactaagtcaaattttaaaatttattcagggacaataaaaagtcacttttcacgtgagtataacagttatatgaatgttccgtcattaaaatttgtcac

SEQ ID NO: 6739 - DNA, 1071 bp, Glycine max
  Soy_ogl_3989 Gm12:3365817..3366887 Cluster 30
ataaaatattttgaataatttttaattttttttatcaggttaaaaatctgttattgcaggtaattttactccctcaccggcgagggagggattttaggatttcaccctagaatccaccggcaaagcagtctatatatcatcaagtttatatcagtgaagtattttttgcaaatcacaatttacatagtaacaaaaaagagagcaaaatttaactttttgcaatatacactctgcaaatgcaagaataattgtgataatgatggtgctatttctgatgtgtttttttagagtatttcaaagagtccaagtcatatatgcgtcaacatttgtttagagctttcaaaggcatgactcatgagtgtgcatgaatgagattggaaactaaatgaatttggtgtagtgcaaatcttcgaatttcctctcttgcactcaaaatgagcctcagatttttttcacccttcaattattttcagaaatttcatttaattttaaagtttctttttgacagacttaattttaaagttgagcttatatgaaaatagattttttaatctgaaatgattttatccaaaattaatatttatttaattctcgaatttacttaaaccaatattttttttttacatataaaccaatattatttagaaaacctttttaatgataatgattaaccctaattttgcaactacgcttcatccctctacctctctcaaatttcttaattgctggcaatttaagtttgttagttccgtgaccttgattatcattgacaggaatttgttaaattctgggaagctttgaaagcttataagctatatataagttatatataggttaagagctaaaagttagttaaaagcttataaaaaattaacttatttaattgaaataatttggtaagattagtttataagttaactaataaatgttaaacgatgtaaaaagacatttaatatttttaaaattttaattttaataacttttcatcttaaaaagtaggataataattttttaaaaattttatattacaaaaaaatgataaaactaaatttttaattttttggaaaagta

SEQ ID NO: 6740 - DNA, 1100 bp, Glycine max
  Soy_ogl_4804 Gm14:47475101..47476200 Cluster 30
aattaatattaatactatatgaaagtactaatgtactatatcctcctattaattatcttacaaattattttacctacatgttttttttaagtgctagatatagcttgttataacttataaccataagacattatttgatctcgatttttttttttttacttttttttccttttataattctatatccctacatttaactaaacatatataattaataaaaatcaccaagcgccataattaatttgcatgaaattatttcaactaggtatttcaacttaacctagtaattgtgatcgcttcaatcacattttcctgtaattatatgcaaagtaaatgtttttttactcaccataatcgcaatttaaaatcttaggtgagaattgatattccattacgttcaaactagatcctacctaattattaagtctttcttcttaagtattgttccttcccgtaaaatctaatggattctttcttttctaaaagattgttgaaataatgttttccttactttccaaaacttttttctgtagtggattttcaatatcttctataggtaatttcttttttagatatcttctataagtcatgtaattaacattccttgttggctacctttagattgactgaagctagaggaatgtactggagttgtatgacatatataattacttagttagtggacatataagcaattgattcgttatattatctactaataagctcgatcagtataattggtataaaaagttgcaattaactcatatacatgttttaatattctaataataatcaaggtgttattatataatcaaacaccataaaccacatgatatcttagtcatgagatgacaaaaccaaacttatcaggagctgcatggtgcggggaatggctgcagtgcaaacaggacactgtggttaaattggaaacaaaacgttgcaatctggcagcggaaattcacgtgtgtgaatagtgatgaacacgctggaacgtaccaaacactgccttaatcatgtgagccatgcaaggcacgttatgccaaacacgtggacccaaaatcatttaagatggtcttcatgccacgtgaaggtgctacatt

SEQ ID NO: 6741 - DNA, 1028 bp, Glycine max
  Soy_ogl_4874 Gm15:11110..2615137 Cluster 30
ttggtttatgcttgggttgttatttactacataaggactttcatcttagtttatgcggcatcatgctagtatagatcaagattcatattctgagttgatttcaattggatctatgttttggggtcgaggtagcctttggttggctttgttttgtttggggctgcaacatctagtcctgatgctgctgtgtaattctgttttcagcacatgttgtgcttttaatgaaagtttattattgccgatcgaccaaaaaataaatgttagtcttactctttatttaattattttgttcatgatttagcgattgtttcaatacattttaaataataaaagataagtgtcttgttatcattcctctatgatcaaatggtttgtaattgttgtttttatttctcacaattagaatatttctgattatacacacatgtaaaagaattatcaagtgagagcagttctcatcttaagaatataagaactataaatctgaattattacttagaaggagctatatgtatttttcttctgatcctgatcatttaattatggtttaatagtttatatttatagtttttttattataataaaaagtgttctcatttaattctacactttctgtcaaacatgtccatagctcctttcatttgaaaagtgcaaaaatagaaggggaaaaggccttgggctctgttggcctgttttcctattgcactgttgaaaaaaaaaaaactttaaaatcaagatgctttcatcaagtcgaaacatacgaaaaaagaaaaaaaaaacattaagacccacatacaaaatattccactccagtttccccacttatggaaagaaaagtacaacccatgaacccacgaggaaacattacgtaaaataactaatctattattatcccaattattatattgttatattgtaaggactaaggatataattgttatttaacatgattgtttttttttttcatttttgtttcttcatcaaaccaatcatgttttttatcatttacggatcaccaaaaaaacatg

SEQ ID NO: 6742 - DNA, 1220 bp, Glycine max
  Soy_ogl_5463 Gm17:2511601..2512820 Cluster 30
attacatctccatatttactcgctacagtttgcctattggttagtttctatttataaactttcacctgaaagtgtaaatacaaaataaccaagacttcaaccaaatatccctcccatcctctattgtcaataattatctaaggaaatcaaaacacaattaaatcaggacaccacacatggataatgtttttggctttctccaataaataataatacccattagttacatagatagcaaggcccctattttcacgatagaatcagatggagaatctcccctgataacttgaatgatttttctgtttcttccaaacagtggtttttttatgtaaccaaaataatgattttattttagtaatattcagttttgttgatatcaggttttagggttaggggtgatttcagaatctaaaagtcataatattttatataaaaaataatttggttcttaacaaaatcttaaagcttctaataattaaaaagactcgtgttaacagagtctcacattagccttcgtcaaacgtcaatcatagaccgcggagttcctcttcttcctaatttcatcaccatattttatgctttgtttcttttatctatctcgttctgtttctgatttgtttgtttctctctctcgttttaatttatctctcttaaacgaagcatatgcccacaatgcagaagcagtatgattacaaacttccggcaacaacgcaatcttgatgatatgttttttacatgacagtccattttttttcaccgtcgagtcactgattttctttaaaaattaaaatcaacagagtcaaaccttaatctatcggataagtttcatctcctccaatctaacaagtcactgggacatattttaaaataactgatttatgggacacatacacgcaccttttttaactttcaaacaaaattatctaaggattttaagtattttggaattaccttttgatttaagtagttttagcattttaatttttagacaaacttttatgctaaggatttaactattttttgcattattctcttatttaagtacttttagtattattctctgatatgattatgataagagttttccttataatatttctcacacaattacttttcaattttcaggcaaactttacgctaaggatttcaagtaattttagtattatcctctgatttaagtactttcagtattttaatttttagatcaatatgccaaagat

SEQ ID NO: 6743 - DNA, 1070 bp, Glycine max
  Soy_ogl_6324 Gm19:1767136..1768205 Cluster 30
aagaatttaagttaaacatactaatagtgttaaaataaatttacatattctcatctaattataaattatcataagtaatacaaatgcttactttatattagttaatttaaaaattatatttaaggtgattaataatatgttaaccataaatctttttttttttactaagttaacaataaatctttcctccttaaaaaaaacagtaaatcattacactcactatacacaaaaattaaactcagacccttggattagcatgactactcttaatagctaatataaaataattaattcgtaataaatcctttgtttcaactttttaaaatatataagaaatgattgcactataccaaacaaatggtcctttggactccattgtgtgtatataaaactaattttacaaatataatatgtgcatataaaactatataaagttcatgatccagttttccaaacttatgggtgtctttgatcatgaaatgtgtgacatctgtttctttttcagcaatggtgaatagcttttcccacagacagttctttcctcgtaggggactcagacaacgagatcatctgtctcctttattttatgttgaggccctttcagccatgttaagaagattagtggaataaggagtgctttatggtataaaggtgtcacactctgccccaatgatatcacatcttttctttgcaggtgatagcatgatttttgttagagcaacaagggaggaagccatgcatatctcgtccattcttcaagcttatgaacaagcatctgaggatcaaaaaattaattacagtaaatatgaactttcttgcaaccgaaatgttcttagtttctgaatttgatgagttgactcaactgttgggagtaaaggaagtggaaagacatgacagatacttgggtctccctactttgattggtagatccaaatctcaagttttcagatttgtaagagacatggtgtggaagaagctaaaaggctggaaggagaaagctttgtctaagggagggtaggaaatattgataaaaatgtggttcaatccattatgtcctatgttgatgggtt

SEQ ID NO: 6744 - DNA, 1100 bp, Glycine max
  Soy_ogl_387 Gm02:5021001..5022100 Cluster 30
ttgatattaatttttggactaaaccaatgttgtccaagccttagttgctataatgagtgattttataaaagatggctcctgggatatccctatccttttttagggacatcctaacttggaaaacaaattaagtcaaattttaattcctttacaagatgcagcggatcagaaaatgtggagcacgacagatttgggctctgtttctctaaaagaagtatacaactttcaaaacccagcagggcaatgagtttattgggtaaaggtaatttggagtaatttcatttccccatctaaatctttcctagtgtggcggataattcataatcatatgccaattgatgagtgtctttggagcaaaagatgcaccgtggtttctatatgcagtctttataatgcagttgctgaaacaacatgacatttattatttgattttgcctttgctagggaattgctgaaacaaccgatgcaaaaaacagaatcacccatactacacctttcacgtaaatagtttttactcttacctatttttgtaagaatttcatcattattgcaacaaaaaacatggtcatttctaatgtttgcttgcttgggaagttaagctttggaactatgtattcagatatcattgagtacaaaattttgaaagcttttattgtttatgggcatctgggaagagctccaatgattaaacaagttgactagcttcccccaaaatgcaattagattaaatgtaacattgattggccactagaggtgctctaggtccagcaacatatggcagtctttagagtactgccaccatagcatgtgattgtctataatgttataaatgatttcgttttggtgttcctcttgtcatttttcctctttcctcacaccatttttttgtggtcttttgttcggttgacaattcaaattaaatacttctgacttctggtaaccaactaaccatgtgcatgcagctaggaattggactacttcttgtgctccagcaacttaactggtatcaatggtgtttttttttttttgtttctattttggcaagatatttgcaagtgaaggtaattaattggatagttttttctattgattaattgtca

SEQ ID NO: 6745 - DNA, 1000 bp, Glycine max
  Soy_ogl_420 Gm02:6546301..6547300 Cluster 30
accatatagttttgtatcggcaaatagtgatgatgcaagtgagaacgaaatgaaatcaatgacagatttatttctttagatttagctcatataattacaataagagaggatgtagttttctatatgtttctgataatcatggttttaaattacagttcacaatcacaattgtggctgcaatattatggttttttgagtcaccataacagcattatggctgcatcaatcacattttcccgcaattgtctgcaatgtaaaggatttttgactcaccacaaccgtgaccacgaccataactgcaatttaaaaccatgctgacaatataaaggatgaaaaatccctcttcatgttcctctctatatgcaaaagcggagaatgcttgttaataatgaaacgaagaggaagaacaagttggtgttggggttgacacagtggaaagagcactgacattctttctcaaccattcttcatttccactgaacgaccctccattcattgattttggtgctggtggcttcttaatctttgtaacaccttcaagcatgtgcaagactttgcttattgctgtcctctgagatggttgctcctgaatgcaccaaaagcttgtttgaatcaacatttttcaattgatccaaattaacttcaggtagtcttttgtcaactatgcacatgataatatctttctcaaactcttcttaagccaaaactgagaactctttgttattggtctcttctgagatttcaaagttcctccttccacacactatctctagcaaaacaaccataactgtaaacatcagattttgaagttactgaaagatttgggagccattctggagctacataccctttggttcctctcatatttaacacggtttggtacctgtcatccttgggagttatgagctttacaaggttgaaataggagagtttggcctcgaaatcctagtccaagagaacattttcaggttttatgttacaatatgcagttatgacactc

SEQ ID NO: 6746 - DNA, 1000 bp, Glycine max
  Soy_ogl_1077 Gm03:43960501..43961500 Cluster 30
attatctattttacttatttattatctaatatgaaaaattacttgttacttgatcgtgcctaaggcttgccaattgccatagttctcactcggtcactttaccgcgtgacatgattttgtttttgcagtgtgaatctatcccaaccatcaggagtacaatactaattaatccattactgtattcgtacccctttctagaagaaataaaatggacaattttgtgttgtttgactttacatcatttagacataaaaaggcaatcacatatccacagtcacatctagatacatttattggtttgaataatctaaaatatccttaaaaaattggttcaaaatagataaatgagcagtggaaataccatagtatggaatagttgttaactagctactgaaactatatatgaaaaaagagaaccaactcatgacatgtttaactcattttttgtgagttttacaacatcacattcgatttgagaatttcaacaaatatttttctttaacagttaaataaaagagaaaaagaatatacattatgaatattttttattttaaaatatttataaagtataccaatacattaaccaaatttttttaactcttaaataaaagagagaaaaaatagaatatatattatgaatatttttacactgtagtatatgttaaagactaaaaccttttttgagacatttttacaacactatttttcctttatttctttccatgatatctatttggtgcttggagttacacacatgcagtgtatataggagttaagagtgtcacatgtgtattgcgtatgcagggctccatgcagaaagcaatggggagggataggtcataggtcaatgccgatgaagacacgtttttaagtttaaactcaacgaagtccttctcctttgtaacgcttcattcatgggttttgcacgagctttccccgtaacttattatattaatatgcatccctcactcatatgcacctctcagaggaaactctgttt

SEQ ID NO: 6747 - DNA, 1180 bp, Glycine max
  Soy_ogl_1495 Gm04:48733401..48734580 Cluster 30
ataagaaacaaactaacatttatctgataaaaaaaaaataattcttataaacaagcctttcagttagctagttaataaattaattgtatccatgtgtgcgagagagtggagtttcaaccctactaagtttagaaaacgatatcttatattgaaaagaaaaagaacaattttttaaaatgagttattgaggttaatattcagatttcagatcctccttaatttgggctatccaagatttaaaattgggtcaaagataaattcgtattgagttaagttcataatctaaaactaacgccggggatatctctcgttatataaaatcttaataccttcgatagataaaggaggaaaaggatagaaaatagatgaggaaggtttagagaacaatgaagtgtaaatagtagaagcttgactctgatgcttacgttgaattgggttggctactattataatttggtttagactgcatagcaattgcgtgggctgattgatccaaataaattcattaataaaagttaaaggaaggttcaagtgcatctagtttttagagttaggtccagcagaacgagttaagcatttttgtttgctgaagaataactattctataagtgtttaggtattctggaataattatttttggaatataattttcatatttcaaaataggtttttaagattacctatatacttccaaaatagctaccgcaaaatatgaaagtcatattgtaaaagactattatgaaagtgtatagataatacaaaaacactatcataaaatagttattttgaaatatatataaaaaatcacatttcaaaataactattctagaatagggtgataaattactttgcgtccgtacgcgagttcgtgagccataaagtgaaagggtgtcggtgcataacgcctaatggggatcatgcatgttgaacttatcgatagccttcaatgcctctgattccaactcttcaaaggttttgaaaactattcttggcttatcttccacgtcaagaacatcaagttgctcttcaaacattgaaaccacgagagagtcaatggtagggtttaaacccaataaaaattatggcaagtcgttggagaaggtgagaaaggagagggaagagagggtgggtttattggtgatgccatggtgcatgtggagggtggacagtaatggagatg

SEQ ID NO: 6748 - DNA, 1200 bp, Glycine max
  Soy_ogl_2101 Gm07:420401..421600 Cluster 30
ctatattccggattttctattccgaaacccaaaaaatagtactcctaaatatatgtaggcttacgaagagttgttccagaacccaaaaagtagtcctaaagggtgtttttgtccgtttagcttggtatggggtgcggaaaaaaatggaatgcaggaagtaattgtccccaaacaggaaaacactgaataaattaataaacagtacttttagcccaacaaatatatgtggctatatgggccaaattgtgagcatcgttaagtccaggtgagatggccatgatagcaagactgtgcgctatcatctcttcatatgagcatcaaaatcaatcaactaatctttcaattttaaaacgggatacctaggtaaaataagatctgattactacatggcaatatttaatgatattaagggtccgtttgcaaaatttattttaaaaatcatggtttgataatcttgtccattagtacttatagaatggaaaaataaaataagtttatcggtaagttaagattagattagcttatggttcaagtctctactctaactagtaatatctagttctctctctctctctaaaaaaaaccatagcaaaaaaaatcaaatattaattagtaaatagtccctcattattagtgggactcacatgcatctcatgcttttctttttatttacatactgtaggtgaggtagttttaatgagtaaaagtatttaacttaaatcttaacacgtaattttctcaccccctccaaagttaagagtaaattatatgaaaagaaagaagtattgctagctactaaatatttttaacaatcaaaatcgaagaatgtatacatttttattatagatttatgatacgttgacatcagggtttatttttttagaaaaaaattaagtgtgagtgaataggtagccaaaatattgaaatcacgtggtatggtagatataaggaaaattaaagtatgatttccaattatcagtttcactgagtgattgcatatcttttacaatttttcaacttaccagcaacaaaatcttttactaggcataaacaactcactataagtcatattaaatgtgcttcaaataatattaatatatgttgagaaccaacccactgccagcttgtcatttgagaactttactcacaaaggagctgactatttgactagtctaaaacctaactttctaaattgttgaa

SEQ ID NO: 6749 - DNA, 1000 bp, Glycine max
  Soy_ogl_2208 Gm07:5242201..5243200 Cluster 30
taatgtagtttttttttttaaggttttaaggatacaaattgttggctttgtttatccttaggctatttatccatattacccagatatagttcggaagaaaaaaatattgtcttatataacccataattatgtgggctatttattacattgagctagttcgaaagaacaacattgtgatgatttaaaaatgtagggattaaattgtttttttttattaataaaagaatcaaattaaatcaattaaataaaaaagagaaaaggaaaagatgcgtgtagtaaatctccacagttgcattcaagtttggcaatggaaacttgtattagatgcgtgtagtaaatctccacagttgcattcaagtttggcaatggaaacttgtattagatgcgtgtagtaattctaaaacaatatatagctagctattgctaatacaacggattgaattagaaattacaaataattttgaattcaaactaaatatgctaagttaataaggtaactccacggcttgaggatatgatgatgaggtttctttggacggagtctctcttcttgcaatggcacgcattcttatctccaaaatgacaacgataataacaaagacgccgataatgactccataagcaagaaaccacttaaatccttcccctcctaaatggagtccgtaagtgtgtttgtattgtaatttaagtcttaagctagatttctagtcccatggaaactacttactattatttgttacatgtatgacagtacaaggatcacatgtactgatacaaatggcaagcaaccagaaatcttttgacaagaatagatagccatcgtgcaatgattaacagattaagaatcctatgtatatgaggaaagattcttttaatttaggatcatagcaatatcttaaattcttaatgattgaagcaaaataattgtgggaatcgccttgctttgcataccatgttccttttctgaagtatactgtgatgaatgcaacagcacaggctt

SEQ ID NO: 6750 - DNA, 1000 bp, Glycine max
  Soy_ogl_2959 Gm09:3029801..3030800 Cluster 30
ctttggaggtggaaacaacagcttaatgattacatgcaggttttcatgattactcatcatggttggcttggtattcaagtggttttgacaatgtagtctaaagatcacttactacaacatctttatgagttcttcggaaacaataccgtcaacagaaacagggcttggtggtttgtttatggttacttcgaaacaatgtagtctaaagatcacttactacaacatctttatgagttcttcggaaacaataccgtcaacagaaacagggcttggtggtttgtttatggttacttcgaaacaatgttgttcttcatcaagagacttgtaaccttgaatctgttaagtttatactttagatcttggatttggctatcaaataaggtaaagagtttctctttcttcttctatgaatggtcaatgtacgtatatatcccatggaatgcttaaaggggttgtaaggagccaactttaggatgtaggcaaagaaggaatgaattttttttacagttgttcaggaagaaaatcaggttgttaggcaaaatcgaagggattgaaatttcttttgcaactgtataatttaggttctgtttttttttttttttttggtacgcataaaaatgaggaactgtttcttgtatgaacatgggctggtgggaaatgatcaactttgttttgtgtaaggtttaggttactcttcgtacttcttaaaaaattatccataaaaattaaattaagagacaaatatcatatcagaaagtttataataaattacctaaagtatatgtttaattaattaaattaaactttcttagtacttttttataatataatttcctttctttggcaaacaaaaaataaaacaaaagaaaattggaaaaacaaaagtttgaacttaaaatgagatgcattataatatatagtagagaggtctcttgagttttgacctccttttgggggttcaaattacactcggaaaccattatattacatttattattag

SEQ ID NO: 6751 - DNA, 1000 bp, Glycine max
  Soy_ogl_3619 Gm10:48380001..48381000 Cluster 30
ggtatattcaaaattgatacagggtgagaaagtaaatgaaaatgagtcaaagttgagaggaaatttcagagagaaaatgaacagagttgggtgagtctgtgtttttatgtagaattctgattggttacagctacagagatatttatacacagaacctgagagtaaggttccatgtaccgtaacctaaactattcgtctattccaatattacttagaacattgactctgtaatattgtatcgtagtatctgtatattttttttctctgtattttgtatccttgttgtgagtttccatacttcagaatcaaggagcatacgcccactcataagaattaagaaccaaccacgctaatcttaaaattatactcatagctttaaattattcaagccaactcaactccaattattaaatcttaaaaaatgcagcagcagcagcttgggtcatattatattaatcattgaaagatgaaatacacatttaacgacttgacagattaaaagcatatttataaataatgggtgtaattttcataattcaaaaactaatgagtagtgtatactatgtcacaggcagaaaataaaacatttcttttggcggtaaaaaaataaaaaataaaaaacctagttcggtgaaaaaaaaaatgcaagtggcactgtggcagggaattatacctttcttgaggcggcgaaagggagaggggaggccccaaccaagcgtctaattgcgatgtaaaataaaatagggatcaaaatacatatttaaacttttcaataatactcccaacgaatattcttaaagaagaacataaaataaatcaacaaaatagggggaaaaattagttataagttaagttcaatttatacattttcagtttttttaaagaaaatctcttatttaactttttcataaacatctataaaattaataaaacttaacatcaatgttaaggttatagcatttaaaaatgctcataagctgtaaattagtaattcaaaacg

SEQ ID NO: 6752 - DNA, 1066 bp, Glycine max
  Soy_ogl_4124 Gm12:37492135..37493200 Cluster 30
cagtactgcactggaaaaactaagatttaacatttcaaaattcaaagattaaatttggaatcggtgacatttggatggacatttaagttatgcttcactaattgaactcgtgtattctttattctattatcccataaatatcaacggtaacattagaagtctcatgttatatttcaatcccctctcttgccctgttccttttgcaaaatgttttcaatgtgaacagtaaagtattatactatgcttttgttaaacagaaatatggggatgtagctcagatggtagagcgctcgcttagcatgcgagaggcacggggatcgatgccccgcatctccatttttttatgaaaatcattacatattttcattttcaatagtaattaacatttccatcctaattttttggtaaaaaaagaagtaaccttttttttcccgtaaaatttttcttgttgattattttccaattttacacgaaacagttgaggtgtctcaatctgagtcattgacaagccattgaacgtgtcttaaaaagcttaaggcttacacgaaactatatatgttcaattaatgccatttacatgtttgggaaaaaagttgcctctagtacagttatatttcataaatcaaacgcaacctggtttttttggcccatttgattgataaggttgttgggagcattggacacatctcataaaaagttttaagttgtttttgctatataattgctccattgccttccatttcttcaacaagtgcctgtataagagatgaagtttcattctctttttagcatttttgtgggatgtgttagtgggaatggctagaaattctatgagtcaggtttgaattaatcaccattgttttagggtccatttgtcctaccccatttcgtcacacacttgatatatgatttatcttgctctaaagaagtgtcattttttaataagattttatagttcgtatatgcactaatgcactatgcagtgtgctttatgtaattatttgaggtaggcaaatagtttattttctaataagagttttttggcttgcattaatttgatagttga

SEQ ID NO: 6753 - DNA, 1174 bp, Glycine max
  Soy_ogl_4597 Gm14:1038901..1040074 Cluster 30
ctctctctattcttatactgttatactaacttactgtagttgtttcaagtctctaagttgtgctgttcccatatatcatgcgttgtccttgttgtctttatacatgaatagatttagaaacttgatattgagcacaaaagagtaatccctcaggtttcaggccgtctaggaccatatttctcctggtcctggcacagatatcaatatgggttggataacagagaatatcccagagctgtaacatggtctaatgtgtttgaatttgagaagggtccagaaaatggtagtgctgagctaaactttcgggtgaagttacattttgtgtgggaatgaaggtgtcacatcaagtttcatttttgtttacagtgttatgcaaaagtgaaactatagataaatcatgggggtatctggctgcaaagaaaaaagttattgcatgctaagtttgattgatggattctgttccttgcggatgcattatgcatatgaaaatataggcattaatatcacttaataaacctggctatacttaccactcagaaatttcacaacagtgtctgttataggctataattgtttacaaaattaatttttggagacaaaatgcgtatttaacacctaataaaagagagaaaaatatataatatgataagtgatataatgtaataataaaaaaagataaagagaaataatgaatgttaatgaaatgtttgaaaaagttgagtgttcaaatatcattcttcttgctcaattatttaaggccttgaacttcaagagtattatatatgttacctattaacattaaagggcaagtcaaaccaaatggcgtgtaaatacttgatagataagtatgtctcataagtatgcgggtagaaataaaatcttaagtgcatgaaagaacatatattagaagatgttagctgtttaaatgaattattaaatcataccttgaagtattagtctatgatttgcggaaagtttttctttatcgaatttagaaagatttcccaaataagatttctgtatcaattctttgaaactgaaagaactgtgtcaagtattgatatattcctgggccatcttccgatttgatatttgtgaaacttcactttcgtaataaggtcgtcttatgttgggtgcatgcaatcattgacttgcatttgctcctagtcctagc

SEQ ID NO: 6754 - DNA, 1000 bp, Glycine max
  Soy_ogl_5430 Gm16:37331301..37332300 Cluster 30
ggggtgttagtaagggtggtgatgaaggctggactttggtgaaaaaccagaaatcgctcaaaccaaatgtggtgacttacttttttcacacttcccggatggttttggtgtagaggaattcaggagtatctttggtagatatgagaaagtgaaggaggttttcatagttgagaggaaaaataaatggggtaggagatttggttttatttgcttttcaggtatccaaagtcactagaaaaaggaactagataacattcacattggtgatcagaaaattcatgtgaatttacccagatacagaagaactggtgatttcttttccccgaaaaagccactgcatcggcctcaccaagtttattcatatagggagctgtaccaacataaagctaaagatgaaggtagagataatttcatgaatcagtcgttgaagtccttaaccttttaaccacaacaatggacatatcagaattcacaccaatgatgggaagttgaaggggctgccagttaagaaagtatggagagtgaaaaataacaacgacaagaagtctgtaggggatgattggaagggtatggtaattaatgtaaacttagatgataaaagttggctcacagatagctgggtggggactcttgttgatcttaaaatgaatgatagatcacgtaagattcatgttatggatggaagtgaggaggttaacctgagatatatgggtggggatttagtactaacaacagggggtgtccgatgaaaaggtacatgaactggtaaaacaagaaggggaaaattctctctatttttagttcggtacttggtatcagcaaatcgattggcctgggttcagtgcacggggatacccttgaagcatagggacatgagtgtttttccaagctggtgaatggtattggttcacttattgatattgatgaaggtgccagagatatgcatagggttgattatgctcgagttctcattagcacaacttacccaaaagcccttgtt

SEQ ID NO: 6755 - DNA, 1000 bp, Glycine max
  Soy_ogl_6631 Gm19:49771901..49772900 Cluster 30
caaagagaagcactgcgcatattttgggattggatttggatataaacatgtgagatctgctttgggttcggctgcttcatgctggcttttcgtccactagctagcacttcacggcttcgtggatgccctttttagtttttatggacggaaatcccctctccttgtttctttctattcttgttctcctaataaacataaataacacttaagcaataaaaaatattgtcttagaaggaaaaaaaatatatattagttagcctcatccaagaacataactgtcaaccacgatcttgaactttgcaaataacatataaataattttttttttataaaaaaatctgacaattaaaatggaagagaggaaattctaaactagatataacaaatgtggagtaaatactcgccgtgtccaatgccacctcaacatgataattacgagttacaattaatatatatagattactccatctttgctcgaagctcaatttgtcttgttttgagttaagaacttttgaaagacctcactagctattttaatacataactatatcatctcatgcattctcctatatccatgtaggcttcatccccattctcctattgtcatgatgacagtgatcccatgaaacatcctacgcacaagttaagaaatactcaacacataagtgtaattacttagctgtcaaataaccataattagatacatataacttacctcgatcgaatttacttgactaatccttcccaacctcttcagaggtctcacttctacaatggtaaaaacctcaaaaaatgtcatggtggtactttcaagtttcaatcgcaccaacagtcgaagtccgaagtccacatgcaaaaaatctagagtcattttccccatcaaattaaatttaaaaataaaattgagtgcttagtatatacataaagaaataatgtaacttagtagcaatcaataggatgtttaatggctttccagtcaatgtccttttagatatgcctc

SEQ ID NO: 6756 - DNA, 1022 bp, Glycine max
  Soy_ogl_7018 Gm20:46561579..46562600 Cluster 30
ccatgcattcaacataatcctaatctactttatctcgtttgtcaagagaccaaacatgtgaagtgcacacaaccttatattcaaaagctatttcgcaagaatcccccaccatagcacaaaagaatttaacataaattgaaaagacactttaacatgtaaccacaatattaaataccgatgtctttctgtccaaaaagacatatgtcagtaaattcatgtgatataggccttgcgtgtaagaaaaacaaccatgaaacaattataatattatatagaattaggatataatgaaatttctacttagttgttgaagtcatcatcatcaatactattacacatcaaattccctaaaaaaatatatgaaaaggccaaatcttcttctcctgccttatcacacttttaatctaagctctcaacgcagcaagtcatagaacaaacaaacaactgaaattatcacagatctaaaagttaagacctacacgtctataccgttgttcacaccgatcaatactagtgttgggtattcaaaattatcaaatgatcattatattagtaaatttcagtattatctaatgaatcacaatattaatccacttttgcaaatccaattggttgaagctcacatgccacaagaatattaaaatagaaatattctctttgtatcagtcaaaatagaaatattcttttggggtataaagtcactaagttggattcatcatatatatatagcgagaacaccagtcagttttcacattttaccaaatattatccgatgactgtttacattattactatttttttaagtatattttgtattatttgataattaaggtttatacaaggatcatcatttttttttggtaaatttatacaagtatcatctaattagcattttaccgtatttgaaagccaactaaggagacatgggacagatttatttttcttgttttctagatactgggacagatttcatattatatgaagcatcatgcaaatgcaactatatataaggcaagaatgta

SEQ ID NO: 6757 - DNA, 1200 bp, Glycine max
  Soy_ogl_2863 Gm08:43042701..43043900 Cluster 30
acaatatgcagtcccaacacgtgaaacatcctgatgaatggagaatatataagttacaacttacaattaataataaaataaaaaaaagttacaactagaagcacccttgacctatcctcaatggaatgtggtgtgtgtgccctggtggaaagttcatgaggtccaccagcacggtcatactcatatcagagtgagcatgcatgtgctcttctctactccctgctcttatttttttttctttctttctgcagtggcatatatagccagaaaatttatgtgtcacttgttagtcccatatatatgtcttgtctaactaataaatttatatgttttatacataacattcatatgcattggagtgaatataaaacaatttggtgtacatcatcatattaatttatatccaattccaagtaaacactactagctagctagtggtaacttttggaatgttcacatgtgaaccgtgaattcttggtttcaaaattgttattcttaaaaggggttaaatggttaactcaattttacaaaattttctcaaacagatatatagtaagatggatccaacaaagtttattagaatttctttttatattatcttaaaaaatatgttaaggcgttgaagttattaatttcttatttatatttattattttgttcatatatctttagaggatctgagatctccaataattattagacacaagaaattgacttgaggaagtgagaatggaacataaaaccaaacaagtataaatatttagttaaaaaattaccttgactgtttttttttaaggtatatatccttaacttttattttaactgattttataaaatcaaacatggaccaaatataaccactcaaactttcagatgtgaataagcagacacatacaacatataccaagtaccaaccaccagccacaaaattaaaccacagcagtacatagtacatgaacgtacataatgtttgttgcatgataatgtttgccccaccccacacgagcctgcatgtgcccaacatatagctgcaacctgcaatttgccttgtgactctttcctcggttcacatggctaagtaactattagttaaaagtaactgttttacctgtttcctatgaaccacgacactgcaaaagcttatattgtctttatcttgtgtcagaacttccacaccacgcgcggctgcctgtgaaagaa

SEQ ID NO: 6758 - DNA, 1000 bp, Glycine max
  Soy_ogl_5433 Gm17:571101..572100 Cluster 30
tatcacatgacatctttttgagaatcttcttaacaactataaaaggctcattaagtatgatttgacctaacatgaaatattttgagggtttacaacacctgatcgagttagaggatatcaatatggagatttgtcatgggaccttcatccatctttaccatctcttcatcaattttcttccttgttcttgttatgagtagctaattcctcatggtgcttgcttgggggttgaaatgtaccttatgtattatctttgactattaatctaagtttcatattccttaatcatctatcttattttatgctttaatgttcattgtggagtgatcaactacatattgtggatgctgttacattgggaagtgttgctaaatccatacataaaatagggtaactaagggttttttttttccactaggaatagtgtataaacacttagccttcctttgactatgagatttatgcaaatatcatcataaattactaaggaattgggacttgataattacgtttaggactaaatcactatggcattaggatttagaaactttcatagtgaggattgattgtatggaatgtgttgcttgtttaattgtcattgacacacttaggtaaagttggaatgaattccaaccccaaacactctcttttatccattcttaagttcatataagaagaggaaaaaaacaaaagaagtttcagtttatgttatatttcaatagttgttggtcttaaatgcaaattattgattcgttctccttagttagcaattagtgtttcaattgatttaatattacggaagtttcttgggagatgaaaatctcataatacttcgatacttgtgccattggtatatttaccaaatccttaacaacactcttttttttggaaggctccttaacaacactctatattatcaattaagttttgtaaaattcatcaatccgggcattctaggagtggccattgaattgttgatagtaagatggtttatgacaat

SEQ ID NO: 6759 - DNA, 1041 bp, Glycine max
  Soy_ogl_5461 Gm17:2489228..2490268 Cluster 30
aattaaactgtacggatacacacatgtagtctcgaaatagttctttaacaagttggattctatccaagacgatgcatacaactgaatattgaactgataggtaatagaaacaaattcgtgtatgacaaatgcggtacctatgcagattgattcagcttgacgagttgtatatatgtaccttacagaaagctaggctttatcactagaatttaccgatcttattaatttctctggtgtgaacagcagatcgatcgttcagcaagtcctagttcaaaatggagaagatatagtacctcctttagtgctatatatgctatagcctattatatattagtaatatatagtactaggctttgtaactgtaaataactataggacttattctttctagctagaaaaatcattcaagtgcctcgtagtttcttcattttgtatgacaaagattggttttagtgctcctcaaggctgtgtaaagacaacctacccttgtctttgctctctactatcttttcctctagtgactaaccatgccatattgaatttatcctttgttcttgacgacagtaaagaaatgtaaactttttttttagaataaatgaaatggaaactaattgtacaatccataggatcgatgtatacgtaaatatgccttattaaagataaaagtattatatacttcagcaagggtaaattaataatagtattatatttttggaaattaacaaggctaattaagtatatttttttaaaaaaatatcgtgcaattcatagcgtataattttttgtttttattattgtgacatacccgtggcatataagctagtcacattacatctatcaaatacgagtttttaagttgatagttttttaaacaacaaaaagtattcactaaccaaaaacacaggtagtagcttatttttggtcaaatacttagttgatgactggtttatataaactactcaattatcttctcaaatacatacatagaatatatgtacaatgaaaatttataatgacatactcttaaatagtctctttttg

SEQ ID NO: 6760 - DNA, 1000 bp, Glycine max
  Soy_ogl_1557 Gm05:2652201..2653200 Cluster 30
gttgaagtctttttataagtactcaactcatttttactacaactttttttttttggtgaatcggagaggaaactatccccaaaaaataattaaaaatcacacggaaaaacaacaaaacttacatacgctaaaataatgtttcataaaaattgaggaacatcctaaaaaattcttaattatctatctagatctagaccaaaattggcaagcttatcagttacttggttaccttttctaagagaatggagacaaacaaaacttcctccttgttccttaaaagccttgatatttgaaaccatgctagaacacaggtgaaatgaagggcaaccatggttcaaaagtaaaatagccacagaagaattatattctaccatgaattgcttgaaccctctacttcacacaatatggattccaagcataatagcccaaagttctgcaattacatttgaacaatggcctatatcaatagcaaaatagaagttgactttaccattagaatccttgagaactacactagtagctaccttcttcatgtctttattgattgaaccattagtattaagtttgaactagccatttggaggcttactccaactaatgcttttttgaccttgaactctagcttcatcgagggcaataaatttcatatagttcatactttctgccactacatcagctttgcccataatttggctcgatatcacattcggttgaatctaaaaattctcaactatcattttgttccgacaccaccataaaatatccaaggctacaccaaaaacctgattccaaaattctgcttataaccaaaacatcagatttcccattgcttgccatccattgcctgaaatcattcacaaagaagttagagggcatattctaattaacaggtaccagacaactctggccctaggacaccatctaaaaatgtgatctaagatttcaatatcttcgccacagtttcgactagaagcatcaaccgtgagatgtctggttttac

SEQ ID NO: 6761 - DNA, 1000 bp, Glycine max
  Soy_ogl_3534 Gm10:44947401..44948400 Cluster 30
caaacatgaaaaaaaaaactcccagaaaactaaaaatcttaaccgtatcaaacacctccattagtgtctaaggtgacgataatgtttaaagccctagctagaacgacacgctttcaaagaacaacaaatattcggattttgtagttgttggtttacaaaagagcattttgagcccaacattactcttatttactttttacatatttttaaataagatacgcacctgttaatttacaacttcaacttttctctccaatcaaccaaataatttcaaacataatcttacatcccacattcagacaatactagtttatcattttatttttataatctaaaaatgcatcaaattagaaaatgttaaataattaaaaaaaaaaatccccctcttcctactcaacccaacgtttaagcatatcacaataggtcttagaaaatgagggcataaccacgaaatcatcccattccctccatctccaacaatatctcatagcttccatttctccctttccttgtaatagatatacacaaagttttagatgtagcaagtcaacagaagagacaaaacaaaaacaaataataaattaaataagtgatgcattaatgtgctgaattgaacatgacaaattgcagctctagatatgattgactatttgatgccccattcctccgccataaaaaggggatgcaggaataaatgttggttagttgcctttcaaatacaaaaacctcaaagttatgaccctttctcttgtttgtctactatcacaaccatcaaaacctcacctaatccctatatagttcttcaacaagccagcatgattcaattttcccatcccggaggtagcaaccctccttgaccatcgcctttgaaggttccaggaattgaagcactcaacagcacgccaaagaaaaaatttagtcaaatgcgcactgctcagttttgaatttatctacttaaattcgggggcgaattaaggtttccagaatgagaaaaatgaga

SEQ ID NO: 6762 - DNA, 1208 bp, Glycine max
  Soy_ogl_3613 Gm10:47858901..47860108 Cluster 30
ggaaaggttgaacaccatataagtgaggagaagacccataaacctgagtcttaaggttttgagttagagtgtggtgtcaggtctaaggtaaatcttagacatgaatgccttgtaaccaattggtaattagtgtcttattattttctagaaaaagcctaagttgaataaagtaaaagtgcaaatgtagatattttaatattgtgccgagttcatatatcctaatatcatgtgtggttttgttgtaatgtcattcaaaaatggagctatgcgagaagctaagaagttcaccccagaaaaccccattaaggaaaatcagaagggagatttcagatcggtaaggtttagttatgaagcaaagttattaatctccttacgtgttcaggctataattatatgttattagttttattggcagttggatttgatatatcttgtaatgatgaaaatataatttgtatgcggcgcgtaccagtcaaattcatgagagctgaaattggagttacgtgtttgaaagaaatcgtggcatgtaaacttgggaggtcatgttccaacaaagttatctaaaggttggcccgaatttgcgaaggaatgtatgttgcaacctagagatgtttgcctctttgagttgctgaacaaagaagatgtagtgtttgatgttcacgtttttaaaggagactcatttggacctccttttcaatcctaaatatgcacaaattgaccttttgttgtagttattaatctttaaacttgtaaatgattatcatgtttgcaatacttttattaggtttgaggacaacgtacgtatgcataacttcagctaaatattatgcgtactttggtggtataccactgctaaacgttcctacttcggagtaattctatggagttatgtttataactttatatagattctggtatatttgttactccatgttatacgttgccttaattagtggaaacagtttgctttattgaactttttttttatatataattttttaaacattaaaaaatagatcagtatgagggcttgaaagttgaaatccttaatgcatcttatctaggacttgacgtcgaagataagtgagaaaaaacaactactactgcagtttgttttctagttgaattagtaatttgaagcacgagtttagtttatttaaaaataaaaaacttgactttaatttgtataacttatttataataaaaat

SEQ ID NO: 6763 - DNA, 1132 bp, Glycine max
  Soy_ogl_5581 Gm17:8203269..8204400 Cluster 30
ttaaatgggtaaagggatagtgcctagtggttctttggacgaataggggaagtgctattattgaatcatgtattttttttattatatttcgaaaaactcattttaaaatataaatttatattttagaatggtcattctaaaatacataaagagatgcaggattcaaataagggaatataggattcaaatgcccttaatctaacttaatctaatgtacaatatttaggctcaaagttttattttcttttccttttttaaaatcaggggaagggctagtagttcttttggacaattaggcaaagtgctttagggaattgcttcctgcatctcacaaattacctcctgcaacccatggaagttttaaaacaaactgaactgacagaaggaggaaaacaactgcttcatttactaagggagggagactgatggaaggggggaaaagagagtaatatgaggatattaaaaattatatgggtgcaattagcaaaacatggggtacatgaagcaatttatatcatgttcagctaacgcgggactattgctaaatacccctcattgagttgctaaaggaacctccatttaggttttttctctcaaaaatacccctttcagaagctaatttccaaaatatcattgttctgtatgatgtatcatgtatattctagaaataaattttcgaacatgtaaacgtcactgccacttgccaataattctcacattaaaaccttcattgccattcaacatagctctacgacctcattgtttctcatggctcaaaacgaaattacctttgaatattgttgagtggtaaggcacgcaaatgcaagatcaaggtctctagtgaaatgttacgatggcgtcaacagtgatgtgtaggaaacaactctgatgcgaaaattagcatatgagagagaagttgtaaaatgagtggtcatacatggacatgacaaaaggagtcccttatgtagagcctttctggcgggaaaagtcgttaggtcacttgagtatatcacgtggctaagtgtgttaattaggcatatttggcatcaagtgttcaaagtgactattgagaggtgaaatcgacttaaaggtctagctagactctagaggttcagatgacctccataacaac

SEQ ID NO: 6764 - DNA, 1200 bp, Glycine max
  Soy_ogl_6552 Gm19:44177001..44178200 Cluster 30
acttttttttccttagtttttggggcttcattgggaaatcattatcatcgcttgaatcaatgttttcggttaccatgcttaggcctacactaaacctcccagataacaacatgatatcttctgtttgctcatttgtgagtcgtgaccaaagttaatcacaatattctgagttctttgggctactcccatctggtttataaaatttgggaatagtaaaggtgaatactagccaagcatgcttggattaaggtgatgtaaacatccattgagtaaaaagcgtccttctaaactatccaagcactagctcagagatttggtgtcccaaaaagaatcagttctaagaagcattaccaccaaaaggaattcccaagtaacaaatatgatgctgaaaactgaacaaccagccaaagcacattggaagaaataacttgattatccacattcttagccacagaccccaagttagccttcaatccagttaaccggagatgacctcaaactcaaagaacataagaataagaaaactcacaagggtatcatatactcatttagaagcagaattgtatcattaacaaacttaaagttagaccatgacctactaaccaactttgacacccttatagagattactatccacagccctcaaatttgaaacaaccaacttagaaaatcaggtactaatataagtaaggtttggatgctctgtgacaaccattgggaaagtagcatttaagaggcatgcagaaatgcaccttctccatctagaactgacaccctgtctattaagaaccttgtttataaaactcttaatcacaatctttcttgagaccttgttatatgttatctgataggctgatatgctattcttggagagtggttgtgtgatcgtaagataatttctcgtgggaggagaatatgttccttgcaatatttgttaggagatataaatatctggtttaactaacaaaagctcatgttacttatctctctagagagaaggaatccgtatcagcagtatgccttttgttgtttgtctgaacaatgtctagctttatcaggagatctttttattctgcatttcctgcatttgcaatcagttagagttgctgatctttcagtcctccatttcgggtgtttgcatcatgaatgtgatgtgtaatgcttatgttagcgcatgtgcattagtgcatgcctacaaac

SEQ ID NO: 6765 - DNA, 1022 bp, Glycine max
  Soy_ogl_6766 Gm20:35128101..35129122 Cluster 30
cgtctaaagaaaagaattatgacagtcaaactaattcaattgtcatgatgccagtaacataaagcaatcagtcaagttagcactcagcgatctcacttatctgatctagttctggcatgaatttttttttttttaatcagcctataacactataaaaataactaacaaggaattgtgccgaagataagaaaaacaatcgaatggaataagagttgacttatgaaaaatttataccaagcgtaccttcagaacagttgaacgttttatggttgacaagcagacattgacctcctctgaaattatagcactcatagcaatcattagataatacaacttcaagaaccatctcagcagacacaaacggtagaatgtctctggtatcagtctcggtgaaagggtaacggaaaggccttacattcccacaatagaaggaaggtgaacagttgtacacttgattcctatttttataaccagcagagagaatgagtacaaggaaaagtaatgaactctctattaatgctctataaatgaagctatgccaactgttattgatctttcacagattaaagatcgatacaccgtcgtgtatcaattcatctaaaagaacgtgtttgataattcgcaacttgacttgggaaatgagcatgggtgacttggagaaaaatagaggcagatgcaaatagttatcccagcaatgaagtgtcaaactaaaaaaacaaaacataagaacatgagagaagatagcaacatattttatatctataacaatgagtaaagtctcaattctaacatgaagcacgacccaccgtgttttccattaaattctcctacggatgatacttcatattggctcaaaaagacaggacgggagttaactcttccaaattcccacatttgccaatttagagttcaaagttgtgggattcttgagaaaacttgaaaaattaagagggaaaaaattaagagccatattgatttggacaaacgttgtgtataaatatagacagtgtgcttatgatgat

SEQ ID NO: 6766 - DNA, 1211 bp, Glycine max
  Soy_ogl_4451 Gm13:34743790..34745000 Cluster 30
tactccggttagaagaatgtaattattgaagaagaagcaggaacgatgaaagtaacggttatctaatctagactattcattgactaactaatgctgctatatatattttcatacatgcttcactactataagtgtgattgcgtacactagcaagcaactctagtcatgatagtagctttgatagattagattcattatatatctctgtataccttagatgaaagcaaaaaggattagaaagagcgacgaaaagttacaatgggtacagaagaagatgaagaagagtgattgtaatttgtaatcgtcttgtggacctttccacgcttttagatcatttgcaacaaaaataattgcataatgaaacagtaagtgcatcaagaaaaatattaaattctctatcatttgaattttctttttccttgatagtgtcacttgtgaatagatacatcatacatcaattaaaatatattctcgacacgttatatctagattctagatatgcctattgcctaccatctttgaattatacgctaatcatatatagtttaagctcgagatgtcattgtaccaaaaatattgaaattttgtcatcagtggtgttgacgtgaagtttccaaactccatccaagttattattaaattttacacaatttccacattttgcttactatatactaaaatgacgagtttgttggaataattatagcaatgcaagtggattatccatgctcttatatatatagcaacgaggcctaagcccaaaaggaaaacagattacgagatattcatgctctttttaacctccaaatctattaaaggaaaaagaatggattacaagttagactaaacatctgttaaaattttacttcaaagcaatgttcatataccaatccaccatgcaccgacccacctcaaactaatgggaaagaagtaagatatgtgattttaggctgtgttacaagtatatattttaggagttatttgatttaagaaagtattttatatttttattgtctatagtcacttcatatttggatcttttttcaataaaaatttgtacaaaaagaaaaataagaaggtaaataaattaaatttttctcataagttaaaatcaacttatgcactttaatatatttattatttatttataataatagattatatttactatcatattgtattttttccataacatgttttatatcaatatt

SEQ ID NO: 6767 - DNA, 1100 bp, Glycine max
  Soy_ogl_1226 Gm04:5253301..5254400 Cluster 30
tcagtgcatacgtttcactattttgaagcctacacttaatagctcataaattcttgtgctacaaaacctagttgtctttaatttcctcgttttagggtgcagctaccaagattttcttgttagtttgtagcttatttaactagcttaaaaatttgattaactaaatgaaacttgtttggaaattgagtttatttcaagagcttgtagtgttggggttttttgaaatactatttcatgtagcattcgaatgtataaacttttagacttttttttttctattttcatcttcaaattcttgttagaattctttcttatacattgtttatattattttacactttgaaactataatttgaaatctaattttatcaaatatatttaattcaatagactaaattttcaattttcggttagcttgtgcctttttttttgttcaaatacatcttacttctatttattttttgatgggctgtataaatggacttggtcattgttttgttgggtgctctccaatcttctacttccttttcttattgacatttgaggttagattaaaataaggagaggagagggaccttagaggtgggggcagatggcattggaaattaggtaaatttctttataccttggttgggagaagggaaacagggcattgtaaccaaaacggaataaagaaagtgacgcaaaagaatgtaagaaattataatatggtactttggcacatacttgaaacgtgaaagtgattgaatgtccaattgaccctagaactagaagaaatggctcgttagtaattagtatagcaggaagccttaagtataaagaagatttaaatggtttcctcaaccatcgatttttcgtcctattctagttgcttatacaaatgaggaatcaatcagcgcaatttcacattgacctttctcttcttttaacctacatgtatacatattttttatttcataaatttatagtttatatcatgtcaccaacctactctgttttttccacatgactccgtttcattgaccctgctaaataatatccttttcacattgaccctgctaaataatatccttttcacattgaccagttactttcacata

SEQ ID NO: 6768 - DNA, 1400 bp, Glycine max
  Soy_ogl_5271 Gm16:3442001..3443400 Cluster 30
ttgtgccggaaagtttgtagagactgtattccaactagagccatttgcaaaaaaaaggtgttcattgtcccctaacttgttctctttgtgatactgatattgagaatgcttttcacgtttttgtgacttgtctaagtagccaagaatgttggcagcagctggggttgagacaaaagttggaggagttatgtttgctagttgaaacattctcggaattatttttcttattaatgcaacagatcgatcatcagcaacagaagatatttgatgcagtttggaatgatagtagatatgattcaagtgttgttagaagaggagatgcttattaattattatcaagactgggctcgagcattacaagacactaagcctaatgaatttctgcagcaacatcattcgagggtttcatggattccaccggttcaaagcaggctgaaaagcaatgtggatgctgcattcttcaatgagatgaactacacaggctatggttcgtgtgttatagacaaccttggccaggtgattgtttcaagaacgtgtttgcctgtcatggaaggagaagcttttggtcttagcttggctgtcaagtttgcgatatcattattgggattgcaaaatgtggattttgaaacagataacaaagaagtggcagataagaggcttttgtctttgaatccaacttatgctgttggttttttgaggagacatagtatggagttgctcatgctttggctaagacatctccatccttcactagtcttcaagttttctatcaaactccctatttcattgctcatttaattaataatgaaatgccttgaatttgctttcgtcaaggaaaaaaaaaagagttgggtggtaaacaaactaaatttaaaaccctgcagagagaattggactttttttttggtttgatcttatttgttagtttctctctctctgatgtttcttttctattttatattctatttatagttatagacgaaattaggtgttcacaaagatattaggaaggaaaaaacaggttattaatacctcgatcctccacttgttttgtgtgtatcaaccaaaaaattattagtatttgaattttaattaaacacattaaatatatatttaattttttgttcaaattgaagattttcctctcgtatgtctgaaaaatcaaaatactattattatcgtaactaatcttgattaaaaagtaaatgtaatcagtacgagtatgagatctaaaaaacattaatgacatcacgagccaaccactacatactattacattacatgatgatcatcattatatagatttaggattatggttgataaaattaggtgaaaaattagttcaaaattaaaaagttaactaaaaattgaaaagttaattaataattaaaaactggtag

SEQ ID NO: 6769 - DNA, 1089 bp, Glycine max
  Soy_ogl_6359 Gm19:3509301..3510389 Cluster 30
ataacataatttttttataactggaaatcaaatataatgctagggatttaggatttagtaatttatgataactcaggtacttttcctcattagaaaaaccaaaaaataatatgtattggtctctatgtgtttatgcatgataattaacatagtgataatttttaatgatcataataatttttaagaattataaaaattaaaaaccactttgttacaagaacttaaaaattgtagtattctatttctttcatatgaatcatgaatcatgaatcttaaaattatttgagggctactctagatcgatacatttcaatcaaaaacactttaaattttgcagcaaatgagtgactagatcaaattgagtggattatgttaattttgtgccgcagaaaatacgtttttctaacccaaaaacttgactcaactcgttcttgattgaaatgaaacaattttcaaatatgtcacttacatgggagagacaacctaaattccttgttcaattacaaaaaagtggactcaaagtgtgtatagatccaaacaagttggatttcacaaaactcctcaattatccaaactcatacccttcatctggacatcatggggggcctggcatcaatcttctcaaaagtggtcaacaacaatttggaagcttttcatccttacttaccacttatcatgaagattcaagaccttggactggaattaatgcctgtttgcagcacactctaagggaaactaatttctatgcagattggcttaattgctaaatatgggaccaatcatcatgatggtttgctttcttggatgcattgcccatctgttctaactccccttatgtttactgatgtaatgggagtaattcaacttaggagttagttcagtagttgtctttatgtttttctgttttctgatgtatgaaaaataattttttaaatatattatggtggttaaaactcccattgggttaattacacatgcgaaaacaaaaaaacacatccaagttaataagggctgttttgtgactgcttttgatcgtctttacattaaaataaatgaaacttaaatcatgagtataacttatgaattgac

SEQ ID NO: 6770 - DNA, 1100 bp, Glycine max
  Soy_ogl_4851 Gm15:1326901..1328000 Cluster 30
ttcacttcaatgatatacaacatccataaatataatttacttgaacgtaccgttgaaacgtacgtgtgctaaatgaaaaccgcgttaggctttcaaactactatttactccttggtatttcacatttggagctgcacttaaggatttaagagatctaatcagttgattgaataggattttcgattcccacaaataacgaaaaatatttggagctgtagacgtcatcaagagatataataataaaataatagctcatgcttcacgagggacctttatggatggatggggtcaacagagtcttatcttgtacgctaatcactaattcaccacataaggttctataatccataaggtggtcctcttccaaactcaccagcaatcctcaccattcaaaaatatatattaagaatttatacctacctgaattaatgattaatgacaaagatttaacattatcaagaccaccttataataacccaccaccacaatcccaattcttaaagaaaataattaatagacgcccatatattgtttaacatgctgaaagataaagaattataggcatgataaatattataatgtaataagaaaagagagattaaaaaaaaagataaatgttgatgtacatgaatctcttcaataatgatttggccattaaatttaaatctaatgactattaaaataagagtataaaaaatatattttaacataaggcattagggaatctaagtctaacgttgatagggtgtttataatatacgtgctcgtatatatcattactcaattcctatacatttgtttcaaggatttactattaaaaattattaaatactttaacaagtgtttaagaatttattgaaaatgaccaacaattatcgaataactgaccgatctctctttttttttcctaagaaaaataaatatggagaaaaggataagtagtcttcttttgttggatatgtaggagacttcaaagttcaacgagcattatttgttataacaaatatatataaaagaaaaaaaaacacattctttgttgtcattttaccctgaaattttgtgatacagcgggcgaaaggcccaaaccaaaatgtaattac

SEQ ID NO: 6771 - DNA, 1100 bp, Glycine max
  Soy_ogl_4446 Gm13:34317301..34318400 Cluster 30
tgaactttatccgagaactaatttttttatgagtattccgataactaataatatagtctttgtggagataatcttttattatcaagcataaaataataaaaatgcttgagatttgtccagtgagttcagcggcaactgagttgtgcgtttttttttcctacttcaaaaagaggttgatatcatttcattaagaagagaattattgaattaatatagacaggtgaattataaaaaaaaatacttgcaaactaacatagaatctagacgcctagtaaaagagtgagcattggctcgtctgcggatgaaactcatattcatccgttagagagcacgttaataccatataaaataaaatatttggtttcacatgtttaatttcttcaacattttgtttttgcaaactgtgattgattaagaccaaattttaaattggttctcatgcacaatttcattatgataatacataaattaatttatttttccaaaacaatgtaaggacgataaagcttattcataatcaatcgaaatttcccatttgacgcgaaatatttctttcatgttacgaggatccaggagatatattccgtcgtgtttcacataccatgcactgacgatatacccctttgtgtgcgaagcagaccaaattcagctgagttatattggctgttatatcaatttcatatttaggatcatataacactgtatatctataataaaggctacatctgcagagcgtaatggactaatcttcttcgccattaagtatggtcatcggcttatgttcgtctccatcgtcacagaaagtagacaagactctacccaaagtgttacacaaaattaccttattttattttcggttttaatattctttcccattattgctagccaaatcaagcaacaagcactcgccaacaccacaaataacaagcccatataactattattaggagcattcatggttaaagttgatggttctatatgcaatatgcaaccttttctctttaatttgtttaacaaatgtaatctttggcatggagaaattttattcgtactattaaagcattttcctgaatatagacggcgatgattcaattaaattt

SEQ ID NO: 6772 - DNA, 1007 bp, Glycine max
  Soy_ogl_6144 Gm18:52687601..52688607 Cluster 30
tcagaaagtgtgacaaatagaattttaggaaatctcattcaaaaatgtgtaacaaatagaattatgaatgttaaaatttgaaatttacaaatagaccttctaaggtttatttccggaatctataacatcgacttccggaagtttaattttaagaaaatgcaaataagtttaattttggaaaccaaatttttacattgtttcaaaataattcaggaatgagaaaagaaaatatcagagaatgaatagtgaaaaaaggaggtgcagaaaatagttgccatgtttccaccatgtcaagtaagaaataaaagattggatccattttgtctataactttcacacatatatctttcttaaaagaaaattgtgtttggagcttaatcacaataaggttgctccttctccattgggtgttgtattcaacatgaatagcaaatagtttgagagacggggtctaaggtgtgaaagcaaaactacattcgcactgtgcgtgagttacttttcttggtctttaatttgctgaagtttaatctcagccgtaggtttcatttttaaaaaaataaatggccatgattagttcacggctaccggtttgctaccggtttcgggccactattataaaatagaagcgagaccacggagacctcacgtgcgtctcattgggctttggcacaaagttgttgtcttctgaacctcgggttcgcataagacataatcgagaccactaatgcgtttaatcggcatttggcatttggcattgacttcttgtcttccacctcacgtgcgcctaaatgtatttcgtttccatttattgtcctcggtaatcttgggaactcttcgtttccgacctctttgtttccacctcttctgttcgttaaccttggatcctaagtgcgttagtgattgctttgtttatctcggtactgtaagtgtgttggttttttcatctttaaagtaggtaccctaagtgtgtggtaacatttacttgtttgtttcctctagaatataaa

SEQ ID NO: 6773 - DNA, 1000 bp, Glycine max
  Soy_ogl_6599 Gm19:45498701..45499700 Cluster 30
ttggtgtacctttcaaccaccattactatccattgattgagaaaatcagaagcttcttgctgctgtcttggtcactagctttctttcaagcacttttcgggaggccaattccttcgtagattggtaagccaaaagtgattcctagcagaatgttccccttgtcatttagtctctcctttattaattggtgtcatctaatgtcataaaaatgatgaattggaaagtgaagtgtctagtcaattagacacaaatacgtggttatcatctcacaaagatgaaaattattagttaattaagcacaaatacgtgattgtcatctccttcacctgcttgatttgggattggagagcttgtgaaccctcctatatctgagccaaatagcatatataacataaactcgaatagagtcgagcttataataacacttagctagagatcaatcccttgagaatcatatatatcctacaccatcaacattgattaagggatctttcatcattaaaactactaatgagcaatttaaaagcagaaacatcaccataactttaatcgatcttgataacatttccctttataaaatcaaaagaacacccaagaacagaaaagagcaaaacataaatatatagacaaacaaaacttaatttaaactccgaattcgaatcggtagtttgcaagtcatccttgaactaaaactaatataataaagaaaggtaagttttattaaaggattatgaaaatttccaagtctctttgtaaagacctacatattttagaatttgctcgtgggtttaagactaattaaaagaaacgactatatataatgaagactctgcaaaaagaaatatgtccaatttccataaaataaaataaaaaaagaagaagaagaaatatgtccaattaaataacaagtgactatctatatcgattctttcacaggtccccattcaataagacctacacactctctaggcttgcgatcgatcatatacgccgcctcacc

SEQ ID NO: 6774 - DNA, 1100 bp, Glycine max
  Soy_ogl_699 Gm02:46472801..46473900 Cluster 30
taaaaagagtaaaaagtaaacttgaaaaatatttttaaaataaaaaagaaaaatataataaattaaaagttaaaatattacttaaaagtaacatttaccaactataaactactaaaaagaatcttgtttttgagagaatcttctaaacactactaggacataatcattactaatatacgagtttaacaagctttcatcagtaatagaaaaacaaacccccaatgttctaagaaaagctaaacattatagctaagaatctcccacgtgttggcgccaaaaaacaacaccaattcccctctcaatatcagaattcatcataaatgctacaggatgcatgccaacattatctgtacaagaacattattgtgacttgaaaataccgactacatattatcatcatcatcatcagcccgagccctcaatttctcaatctattcacgagataaccttcatattcaactgccattgagcaaaggtacccacatcaacacacatcaaatttttcaaccaaaaccaaccaaagaacttcatatcttgtatgagcttctctttatcaaaagtgacattgttctattattcctggttttccaaatattcctgaccactggtgcccatagtacccatctcatgtgaccagttgtttttgatgaagtagagccccgatgcttaaggaaatgaatatccacggagttgggcatcacggtgcactcgtccaaccaatggtagcattcgctccatatctggaacgcagagtggcagaggaaaaaaacatgctcaattgtctcaatctccaagttacaaaaagggcaagagagggagattaaatggatttctctcctctcaaaattttgtctacatgataatctcctatgcattagcctccaaatgaaacatttcacttttggtggcacgttcatgttctatatatttgcgaatacattctgactttgacagtcttcaaattcttcatatataacccaatatgctgaatttgtagtgaaagctccattgggaccctgatgccataaccacacatcttgaggtagctttatgccaacattttcgagctttgagagtaagtcttcgtgtagaacctcatc

SEQ ID NO: 6775 - DNA, 1300 bp, Glycine max
  Soy_ogl_5551 Gm17:6541901..6543200 Cluster 31
cgtgtgattgaaaaaatattacttaaaaaaaatcaatcccttaaataaatttcataaaagattaatacttaactttgaaaaaatattacttaaaaaaaatcaatctcttaaatgaatttcatactctaaaagattaatacttaactttgaaaaaatattacttaaaaaaaatcaatctcttaaatgaatttcatactctaaaagattaatacttactttcgcggaggaatacctaatttacccgaaattaaaaagaaacttcaatgaagctgaccaaaggaaaaactaaagccttgcatcttaaggtagtgtaatttctcaacatcatactaaacatataaacgtttatctaaaatcatgttagatagtgtaattttagatgattcaatattctaccaagctataaattgagtccgtaatttttaagagcaaactttaagtaaactagaggcccaacccaacaagcaaacacaaaagaatttattgatgaaacttggcctaacaaaaatgtcttagactaagagacaacaaagatcgctggagatcttcctcaggagatcacaactcatatcataagtcataagtcataccttcttccaataggagttgcctagagagaaaaaaaaaaaactttttgttaggcatgacactttgtggtcgcaattgcggttgcaaactgtttttgacaactatatatgtttgtgaagatctatagttgcagttaaatagtattgcaggaaaagcagaacttaacatgatttcttggatgcataggttcagagaatcttgttgataaaggaaattcaagttcatctcaatggtactacactactaccattaatgcatatttagtgtgtaaactaaggagtatgttctgtaaaagaatgaaaaagaaaataaagcattcacagatgtatcagtaagcaccaagccaaaatcacgaatatgctttgaatccacagccaacatatattctttgtttttacgaataagtcaaatcttaattaactgagttacatgcatcaaatcctacatagatgactacaaaaccgagaaaccacagtgtccttacattaggggaaatgaagatagccttgaagaaatatcatccccatatatctatatcaaagcagtgtaattttacaagaacgcgttgcaaaatctgactagagtacactccaaacgagtaatatggattgtaacttggcctttatatttaaaaactctagtggctagattcaccttccactgtccttcatgatgcatctaatgtgtacacaatttcaacatatctttcacc

SEQ ID NO: 6776 - DNA, 1000 bp, Glycine max
  Soy_ogl_450 Gm02:9128201..9129200 Cluster 31
tggcttcaaaagattacaattactaatatccaaagtagggttatatatgtggacttagcaaaatatgaaccaaaagttaaactactctttaaggtgtgcgaacacacgtgaactattcagcaattttttctattaaaaaattcaacacacgctgcactgtttgaataacttgcaagctaagactaaagaaaaaatcgcatttttgtttacttttaactttatgtaaaattatatcaatgtgtgtattgtctaaccaaatatgcactaatcttattgtcttaaaaatattctattttactagtattaatattgttgatcttctcaaacttggaattatcccactcatgttccttaattttttgttctattaaaaagtgtgtttaaaccaaatttgactctccttatatagatattaattgttcttgtgcagaacaagtttagtttcttaccatacaatataacatcatgaacatcagtgttgcaactgttttaacagtaatattatttggtaagaaaatattcatacaaaaattacatgttatataatatttcataattaatatgattaggaaaaattaacaaaataatttattaaacacgtttttttcaatcatttcataaatttcttttcttaaattcatttttaccatttcatattgtttttatgccatcaattttttatgtccctttttacatgaatgatgatatatattttaacatctcaatattttattccctacccctctacttatgtgtttgagtggatggatcttagtgtgattagttgtaaattttgagatgtcaaagtattctaaatttaattttctcacacatatctttttacattcagtacaatgaaatatagtaatattaatatcttaatcgtgaatagcatgccttattttggccataaaaaagatgagatacttaattatttttggagatggtcgtggataagctgcatagaattctgcattgccaaaaaaagttcatggttacc

SEQ ID NO: 6777 - DNA, 1500 bp, Glycine max
  Soy_ogl_2027 Gm06:21495401..21496900 Cluster 31
actcatatatgaatcaaatcaaatatgtataaaatgtataaacatacattcatataaatgtagaaaatatggtttggcccatgatttttttttgtgtgtgggtaattttatgatatttttaaagttgggggtaggcttagcaatcccctccaatgtcctttatttttgcccatgattttttatttggcccataataagcactgagggactatagtctatggatgggctgcatgcccagactattgaaaaaccacagaaccaatattaaaataactagtaaaaaacaatcagagatatcagccaaaaattgattcacaaggtaataaaaaatatttagtatgatatcattttaattttcacaaaaaaataaaaatttatttaaggtatttcgtaatatcttttttagaagtgaatttgttattattcatgaatatttttgtatatcattgaaacttaagtttaagtatatattatgatatatttaatttaaatttttgtgtattttgaatgttaagcagtggtgttttatttttatttattagatttataaaattatgatattatatatttcatagaaatgttcgtgttaattaatgacattctattttggggtacatggctttaccaacaatatctaactgagattttatttgtaacaaaaattctggcagcctaaaaaagtattagatatagtatcaacaactattaaaatgaaatattattcatcttaaatttttttacttgctaaactcattattaatattttataataaagactatttaagagaaagtggagtgagaagaattttagtgccccactcaaccttgttggatgttaagaatttcaatatcaacagattatgaatataataattatagcaagaatactaaaagagtagtagtaaagtcacgttagacaaagaaaatgtagcaatatttcacaaaagacatacttggtatttcaccatatatactattggtatttttttaattaattaagttaatacgtgtatcaaagttaatttattctaatggattattccaccttttgatacaatctttcataggaataagaacacaatgtttatagggatgaatggaaaagatgggtgatgcgcaaggacattgatcgtccaatggcaagagaagaatgttgcatagtaggttctcttttttttcctttgtttaaaatataagattcattttcccatttctttatttaaatagtagtttctgttctaattggaaggttattttttaaatatatttttggtgaaattttataaaattcatttgataattacattgtttagttagcaaaaacattatagcatactcaaatttaacaaattgtaagttcaaactttttgagttggaacatgccttggactatttttttgcaatcactcccattctctttattaatgtttaatattatatattaaaggttcggctcatccagcgctgcttgactatttggtatttaaataggaagcagaa

SEQ ID NO: 6778 - DNA, 1000 bp, Glycine max
  Soy_ogl_5077 Gm15:21143301..21144300 Cluster 31
atataataagaaattttagaataattatgggataaaggatgtgtatgtaaaagtgtgtataccaaaagtaatgttaaatgaaatattccctttatctaccggtatagatgcaattgctagcatgagttttaaaaattaaatctcttttgctatactgttataatcttgtatcttttgtttaattttatttgatttttgtgatatgtgatcaatttttatgaattttttagttgttgggtcaatttaatatattaattttaaaatcataatttaatttaatttttatgtttcgatccctcaaagaagtgttctaatttcatccatattgtctataatagacaatcattttatattgaagtttacatattttttttcttctgtattaatacactaattaacttttagttttgattcttttataatttaatttttttgtttgtgttctaatattgttaaaagagtgaacattttaaatctattatcataagttccttttttaaaaagaaaaattaattttattcattaaaaaagtcaaaattgcttcacaagaaatgaaaataatcagaactctcctaatatgcttcgcataaattcgtcccaaggaccataggcatacgtgtgtccccatttacaacaaatttacaatttgccccccacccccatcagtatttgctagttatttcacaacttataatcttttttttttaccgttctatcccagttattataaattcattacgtattcatatgtcacaattagttgaaattttatttaacatagatgtattaatataacatactaaaaaaaaaactaacaaccacaaagataatatgtactttcacatattaatttagataaaatgaaacattaatttcaatccgtttataaaaataacataaaatgatttaaatttttttatcacaccactatataaacattttttcccccttggccattgcttcttcggataaggccgaggaccaagcctgttaactgggt

SEQ ID NO: 6779 - DNA, 1325 bp, Glycine max
  Soy_ogl_6095 Gm18:47662501..47663825 Cluster 31
gaatgccatcaagatcgtttaaaatgccaaagtctgaaatggaaggttccaaaggtaacccaggaaaagaacatcacatgaaggaaatgaaggagactgtaactaaaggaggtgtgaatttagtgcctaaggtacataaacctagtataatgatatatttactatttcatgttcggtctaaaaaggaaatgatgttttcttatattaaaacatttcgttgctatttcagaaattcccttgtatgtttagacccaatgccgaaatgaagctcacttccactgagacctaagtggctgattccttttttaccagaagctggacacaagtcgcccagaaaaattgttcatggttggtaacaatatgggtactagattcaactttgagtctttgtgtcccccaaggatgataaaccctaaggtatctgtgtttaaattttttattgtttttatttttatttttgaacaattttctcactaacaccttaacaatattgtagattgttttatttacggcagtaagggtcatgcactctcaaatgaacagacctcgtaagactgtttggtgtctttcacctgcatttgaagtaagtagtaattagcatgtttattgacaatatttggataacacaattttacgtataaaaaattatttaacatttaaattcaccaggcagatgttattgttgaaaaactcatagattattatgaaaaagattggttgatcccttttccatacctaaagctggtaattgtaccgaaaaatattttaatgcatagtgttacacctccaaatattattactaacacgttattcattttttgctattatttaatttcacaatggaaaatgaagatatatataccaatgaaagaaaactatgagcactggcatctaattgtgattaacaatgaggagcaaaaaaactatcagttagactcacattgaacatctgaagccattgacaaatggaaggcaacaatagcctcggtggttcagataatatacttcctttatttctagtatatagcttcattttttctttattaaaatcacttaaatctacaggcagaatcgatggccagacttttgggaactatttttgaatttgaagtttttcatggtggagatagagagtttgggttatggaacattatagagccgaggggaattcccaattatgccactaggtaatttactagttcttggtgaagtagcaaaattaacaaatgctataaaataaattagtcttgatataacaagtaatgaactacaacacgaaaaataaatactctataaataaattgttcacatcattggatattaac

SEQ ID NO: 6780 - DNA, 1100 bp, Glycine max
  Soy_ogl_1332 Gm04:41039201..41040300 Cluster 31
gctcatcgtggtacagcttgctttcggtatcgacagtaaactaatgctgcggtaaaatgttaaatggcttttttctgaggttgcaatctgtttctgcaaaaatgacaaattcaaaacaatatgaatagatagtcacatgcaccaagtctcaatgttagttttgtcttgatcagtgagttattgtagataagttttgcagtgcagggggactcatccactgagtacaatactctgtcatacggggattggaattttattttttttaaaataaaaaaaaagtttaaatgaggtggatctcaaaactcatccgaacatgtcttaaaactctttaagtgcttatagatctcgtcattccttgccatctcacgtctatgtttggcatcttattctttatgatccaaatttgttttggcatctggtgctttgctgagggatcattccaattgaataatctacaacaaattgtaattttgatttttttaaattatggtttaaatatattttttgtctttataatttagtattctttattttttgttgttgtaaaattattttttaatctttacaaattatgtttatttatttttttattcttaaaatactttagataatattttaaatagtgatttttttaaatctaaaacatcataatgataaaaaataaaataaacataatttataaggattgaaaagaaaaaaaatgttaaattataaaaattaaaaagatatttacgcattcaattcttgattcataattttaatcctgttttttttatgattttaattctcaacaaatttagaaggaggggatagtgtcttaggttaaattaaggaaagctttccaatataaagattacttatataacatcttatattcacttcactttaaagagacgaatgagagctcaagcatacatgctgtcaaatacaaaactcaaccttgatccactcaacgggagtttcaataaattatctttgcttatataaaaacacatagattataaatttgactatatactatacaagtattaacatatgctcgatctataatgttaccagattgtcattgctcgacattttaggcattattttgaatcaca

SEQ ID NO: 6781 - DNA, 1579 bp, Glycine max
  Soy_ogl_2775 Gm08:20500622..20502200 Cluster 31
cactcaaatcatagtaatattggtaaggttcaaagtgtttgtatctatatgtaaaatgtcaagtaattgtaaatttaaaattatttaaagaaaaatattttactggaaacaaaataaattaaaatacaaaatttaagagtttaaaattttttaattttggaaaaataattaaaaatattttttatttaatgaaaagtattacaataaaatcattatgcttaattaattagggatgtgaatgagttttctaagttttacaagtcttagtttgaactgtttacttaaatactaaattttttgaaggccaatgcaaccctttaagtttagaatgttgaatttaccctaaaaaaaactattatagattaaaaaaatattaatccaaataaaatcgaatctattttgataaggtcaaactcaagaaataaggattaaatttaattaggtctattttagtttcatattatttatttatttttttcttttaaatttatataaatttacacaaataaaaaataaaatgggtcactggacctagttgaacttcaaaaaatgagactcatataatatcattaatatgaactaatccagtccaattcatttttttgcttaatttgatgggcaagatcgggacattcattttgtcaacaccataaattatacctttattataggtaggttagtgagtataagcttttaataaatggttaaattgatttgcaggtctccataatttttcaaaaaatttattaggttattgaactttttttctttttttttttattgaatccttgaactttttttaattagaggtataatggattagtgttgctgaagtactgcaactccaattgaatctattgtaagttttttttttcttccaaagttttaactttctgaaaggaaaaaaacgtcttcttaaaccttgaaaagaaatgcaattaattagcttccaattgctagtataaatgatggtagttgaaagtgttagtttatgttttcaataggcgatcgatttcgtttaatcgtttataattagctgttaacgtatttcggagggggaaaaaatcctataaacgtgcgtgttagttaacaaatagtttttatgtttaagaggatgatgtgtaaaggacatgattaaaattgttatattgttttaaaattaaaagaaattgaaagtgattcataacgaaagaaaagtcggataagcatacaccgaatgcaatagtggctgtacaagaaatttctgaatgaagctcagaaaggtagacaagtacatccgagagtaaaaaaataaaaaacaaaagagaagaaacttggaaattataaggatagcgaaagttgaaaatgtgtgattctattcaatgattactaatttgagacttagccattacaattggacgcttatcaagtccaatatatgaaataaatgggctgatgcaagcaaagcttaggggaattagtcttaggcacgtaacgtaagtcgtaacctacctctttctttctaaaatgtctttaagacgttttgggttttgtcttagaacgaataattttacccaaagagaaaggacagcgaagaaga

SEQ ID NO: 6782 - DNA, 1088 bp, Glycine max
  Soy_ogl_2735 Gm08:16931213..16932300 Cluster 31
taataaatattattttagttttttaatgtagtatttatactaaagttttttttactggataatactaatactaaagttaattttgtaatttttttatctattaattagcttttttagttttttttatgtgtctaaaataacttaggactacaagtctacaacatcagttaattttaacatgtagtaataaatttttaatacaagtagctaataaatagtattttacactacaataattttatttcgacgtgtgagtcgaatgagagagaaaagaacaaggaaaagttttttaagtttgatattaacatattagaagttattattatttttaacagaaacatatgagaataaaactataatgttgtcatgcacttcttaaactaaatttatgttactatttattctatgtgtatgcccagccacagtattctagcacactttgtggtcaggtagtcagatcatatattaaaaaagaaaaaaggaaaatagttttgtccactatttttgcacctcaccgtggcaaaagtctttcacggccatatgttaatttgaaaatcactaaagtgatagtttagtgactttagtcaccataaatctttatgcgacaaaacttataggcctatgattttgttttacaaaaattatatataattttcaaaaacgtgatctgacaatgttatattatgtattttttataataatatctgacaatattttgaatatgatttgtctttcaaaaaatgacactaacaaaaaaagaagatataattcttaaaataactaataaagagtctctacatgtaataaaatatttactcttgtgctgttaatataggaaaatgataaagatgcgacacaacaaggagacaggaagaaaagcatcttgcatatttcgaaatcattagctgcaaataagaaaagtttaaacaaagtgggttctctatagtcagacagtacgactaaacatttattgcgctttctctgtacagtacaaacggaattgcctcccacgtataagttcaaaatctatttttttctaaacctaaaaacgaaattggggtgatcattacttaatttgaccatttaat

SEQ ID NO: 6783 - DNA, 1009 bp, Glycine max
  Soy_ogl_6159 Gm18:53669401..53670409 Cluster 31
ggcatggtctaagctgtcagggtcatgatctacccctttatttgagggctatgtggttggttgaccttatgaaatcccattctatgggaatcaaacacaaaactgattattcgaaaaatcggatacgacagccatgaaaagcatggacaagtacgcaggacgccgggcattttggtgttttaaaaattgtgaagcacaagatcttgttcatgataattatggtccgtatcttgttttggtttggacccctatatatgccgacgcactaactactccataagctaccaaattgtgatcatagtttagtgtattatattaattagaaatgtttctttgtggttagtaacctcaattatttggaaatgttttcattactaaaattggtaatacataattagttagttttaataatgttgtggtaggaattcgtattcagtagttgccaatcgtttattaattgttaattttatagtaaatgtatacaagtagatcatgagagattcttaggtggtatttgaaataaaataaaatctatcttgttatatattatttcagcaaaattatactcttttaaaactataccgttccttttttatatattgaagattactttttcgcttgagaaatatattatttcagccaaattatactctttttaaactataccgttccttttttatatattgaagattatactttttcgcttgagaaatttatttgtgttacattttttatttatttataggaattaacaacagtagtaagtttaccctaattcataaactttattcaactagcttaattagattcccttaataatatgttatactctaatttatcccttaataatatgttatactctaatttattttaatgtgaaacaagtcttttgatgtcaattattctctttttgtgattcttaacattatcgatattatatttgaattttgttatcaaatttgagactttaataaatgaaatcaaagattgtaatatatagtgaagtttc

SEQ ID NO: 6784 - DNA, 1014 bp, Glycine max
  Soy_ogl_6467 Gm19:40084787..40085800 Cluster 31
tgattatttaaattcgtaaaataattaaaatttatttctctcatgttcatatcatttatgtgaatagagctatttttgttgtaagtttaattgaagaaaaagtaacttaggtgatcaaattaaattaaattgatataataattcaattacaaaaggtggtatatcatatattttaatttttcttaacaaactcgatcatgttaggtttagtactaaatagtttacttcaaattatacttatatactaaaaactcccatatttaatattattggaacaggagattttaattcttaatcagttttctttttcaactactactctaaactaggggtgaccctttgcacacttctaaggagtgaacctaccagagagagagtggaaaaaaaaaaaaagtggatcagcatttgtattgcagtttaaaatatttaaaacttttctttaacaaactcgatcatgttagttgttagtataattaatatgttaaagaaatatcaattgttaaagaaaagatttaaaaagtggaccactcttggatattatagcatggttgtgtttatggaatttgacttttttaacagtgaagttcactataaaaaaatctcaattgttcatacaaaatatgaaaaaaaaaatcataaattaatttacaacttagtgtatatatcatattaatttatagttttccaataatgataattattgtgtttttcaaattagtcctactaaaacgacagttcgagatagctagctggtgcgtgtagttatagtaattatttatgttctatctctatcattaatgcctttcacatttcattctctaacaatactcaattagatacatgtaaaaaagaaaaagaagaatttaaagagaaagagaaacaacaaaatatgacatattgataatcttcaatatttggtttgtgtaatataatcagtcatcaatatcaataaccatgcaaaatgttgcaccatcttgcacaagatataccatataagtttattatggttgtgat

SEQ ID NO: 6785 - DNA, 1100 bp, Glycine max
  Soy_ogl_5144 Gm15:47797201..47798300 Cluster 31
taataaaattaattagtacaaatttctttaataagtataaaaactatttttttcttataatcaaggtcgattagaataaaagtttatgatcaaataacactctgtgaatatgtaatttttttattatttttcttctccctattttttatctagatgccaaatatataacacattaaataattaaaaaaactctaattttggtagctttaaaatttctatttttttcgatagatagtttccaaagataagaataagtagtactataataaagatttactgtttcctaggtgggtacggtcgtcctttgactaattattactgtggatccgttaaagtaaagatttcacggaacgcggttaaaaatggaaagccatggtggttgcactggtgctatctatagtctattattactgcatttgttttgttctgttcaactactgtgctggctctgtttctgttttctgaatgatgaatggccttttccgaatggattagtactattttgaggagttttttttcattccctcgaaaagaaccaaaagaaaaacaaaattatgaaagtaatactacgaatagtggttcgaaccgcatgtgaccggcacgtgactggtcaatttccttttgttttgtgtggctaattcaagtcaatgatggacaaaggttttttttattatgagaatcagaatttggaaggtttttttttttttaaaaaaaaaaacttttttaaacatgaatgaaacatgttgctaacttgcaattgaatctattgataattcaagtaaaatggtaactgaattatcaattctgtaagtgtatttaatttttcatttaagactgtttttaattaatttactcccttctcatcctagtttgttttacaatttttataacaagaattaagaaatttgattaatatgttaattttatatataaaaaattaacataaaaattaagaaatacaatcaatattattttagattcataaaagttatgcaatttttttcttatacatacgaagaaagactaattctaatattctatatttgttctcttgtacagtagtactatgttcttaaaatttagcttaattgttaaataaa

SEQ ID NO: 6786 - DNA, 1098 bp, Glycine max
  Soy_ogl_2060 Gm06:42916303..42917400 Cluster 31
ccgactaaaacagaatttgttgcataattagactcttttgaaaaaactctcttctaaaaaatgcacgcattccggtggtgccatatacaccacggtagtacaccacactacaaaccaccttaattagttggattatacgtaatttgtttttatttatgtggattatattacatggatgacattcattgtgatatttatttaacatctatgataaaaaaagtgagagataaaaagaataaaaaatatttaaaataatgagatttttatatataattaatcttatttctcaatcaacatgatgtcgtttaaaatgtttcaactataactacgtcattgccatcaatccgtggtgcaacgcatgagtctacatttatatatgaaaataattgagtatctcttgtaagaaggatttgaaagatcttagataaaatagtgatactaggaagccactgtgaaacgcatgagtctacatttatatatgaaaataattgagtatcactatcttgtaagaaggatttgaaagatcttagataaaaatagtgatactaggaagccactttgtgtatcggagcctggttaaaaaatatagtaatttagcaacaatataataagcaatgaatcaatcaatatggattgattcagcatttgattaaacccaatttatatagaacaatccattcagttaacatcatatataaaatgacaaatccattttaaaatagtagatatataaaatgagtttttatattattttgttttgtgagtaggttatcttaggctatagttatatgggatgtggtcgggttaacagaaattccactgctagccacctcattggcaggcataggattccatatggtatttttctttgttcagttaattaactttgatgtgaagttattagaaagtaatttgtgtttggattgttagcataagattaaaaatataaacttttacgactgccgttgtataaaaaacagaaaaatatattgcttcttcttatgtacttccaacgccaaaccagataatgcatacgtgttgttcttagcttatcacttctcgttaccacttaattattgtactagcaaatagtattga

SEQ ID NO: 6787 - DNA, 1200 bp, Glycine max
  Soy_ogl_1913 Gm06:11967301..11968500 Cluster 31
tattaattacttttttgttgcataacatacagttcaagaacttggtatattttgtttattatttcttttcacatattgtatattttatttcttattatcttctaaagaatttttttatatggcattaaccctctatttattatgaatttttttacacggcttaacctttttaagaaaaaataaattacctaccattctcctgccaattttcgatgtaaaatataatttccaattcttctctcaaaatcaataatccaatatttataattttaagagaagttatatttttttatccaaaatccatggttgaagttatctttttaataaattttttatccttcatacatgattcattatgactgataaaaagaaatttatgattttaatttttataaaatattaacatacaagtaataaaattcagtgattgtgtatcataagtaataatttacgaaacacacactaatttttactggaccatctatataaagagggatatttttcaccacagcaatggtttttattttactaaatttcattatgcttcgatgttttttttaaggcaaaagaattatatcatatataaaaagcaggtctgtataaggggtatagctgcaataatacatccaaaaagagtgtgtctatccactgtgcatagaattatattaaagcagagcaagggattgatacatcaagaagagaaaaagatcagtgatttgcttctcttctataagaattactgccatggattgatcttatatcttccaagagttttaccccatcaaaatgttgatcccgaaaagctttttctttccccattatgttttgatgttcactcaaaatcttttgtaatctcttctcttcattgaagagttataacaattaattatcggcttaaattggatcagcacagaaaaacatggataattgcacatcatgtagttatttatttgagtgctaaataacattaaccaaatgttctaattgttattatatgtatttgcaggtagatttttggaaggactaaacgaagatgatgaaggtttttggaagaatgaatagtttaattttatggggtaaagaatttaaaatgaaaaacacacagcgatatttaacttttttgcacatatacgctgtacacttgagtagtcacacagttgatatttatgcaccacctttttaaaaaacttgaaatcaata

SEQ ID NO: 6788 - DNA, 1172 bp, Glycine max
  Soy_ogl_6728 Gm20:33614801..33615972 Cluster 31
aatccatgttctcagggggaaaaaaatacatattttggcttatcagctagttccaatccacacacggatgcttaccatttatatatattgaaggagaaatgaaaactgtaaaccaaagcttttacgatgaaaataaaattatgatagatatcaaattttacatttatcttatagctttgtcaattttttctttctattacactttttttttttatcttggattaaagactaacggtgctcttcaacctaagcataatattccataaaataaattgttttttcacattgcaaagtgatcttatattgtcgtgtcaactatcaaatctttgggtttcattacacttgatacttgttatacctttcttcttatatctctctttttacttgggatgtattttaagtagtactgctaaattatcattatttatttaacttagataaaaatatttgtattgcagaaaaatttgtactaccttcccaactcccaagtaaatctacaactgtataccaaaaaacaaatcagtaaattttttcaatgtcacccattatagataaaggactgaagggcattgagttttttttttttaacagtatcaaatagtttaacgtaattaatggtatcttgatctcatcgatctggattatcatgaaatcgtttttgttgagaaggccagaattgacttttcattacgtgcttatccaaatgagtaggcagccagaatatgccatttcattccttctctttttgtagtgttccaaccaaatatcttattctgttatctttctttccgttatttaggtttttaattaaatgttatcacttactaaggtggtggtggggatctcattcaaattgatatcgcggcttagagagatagtactcaaattcaaaatggtaatttcaatttgcatatttttttttcttctctaaaacatactactgaaaagtattgtttcgtaaaaaagaaattgtttttgtaatcaatatgtatattttgagacaaatacggatgaatctttagcaatgtatatgtatatgcttgaatagagcattcttcctaacttactcttttgccctttttcaccatactcattactcaatttgtctcatttttttttactcagttacatagttttttttttatcgattttgttacttattgaaatgattt

SEQ ID NO: 6789 - DNA, 1095 bp, Glycine max
  Soy_ogl_5375 Gm16:29904637..29905731 Cluster 31
agtaaaataattattgtatagaatttattttaaaaataattgggataaataattgtataattggatttattgattgaaattaattttaaataatatattttcatttaggttgtataaaaaatcactttttatgcaataagttatcggaatatgtatgaattgatcattttataatattattaattttttagagaatagaaaaatatttttgtgatgaatttgttaataattatgaataaaaaaggttcagcttgacccttttagaagaaaagattattatttaacattaagatagagttaatataatcaattcatagccttatgtctttctatccaatcatgcactacgtgagtgaataaaacataggcacaaaagtatatttattggacattaactaaattttttgttcatatactggtagttatcttttttaattatacaaaataatgtaaaggtttttttatattatattagttaattataaatcataatattttttgtaactatcaaacttaaagatctttggtttaaactccaagatattctcataagctttaattattaagatctttggtttaaactccaaaatattctcataaactttaattctttgagttgagtaaaagactaataatcatcggttcaaaacttaattacattaatcatgtattaataaaatgttgatgaaataatattgttataggaaagggtaaactaggtatcaaaatagccaacttattttttttaaaccctaaatcctaaatcttaaaatgcgcatttcctcttcccagcaaacccagtcgccaacaacagtggtaagagacacgaaaggtgccagcgagattacatatatcagattcatcgattctttcctttttcatatttcgattgttttaaattttttttgtgatcaaaatatttcaattattattaattatttaatatttatgacatcgagttttgattgatggggaaaagatcctttctttaacgccatagattgaaaaattaattaagttggataaaaattacacggataagattgaaagttatctaccatgtctgtccatctcaacaaatactacaatgcgtcg

SEQ ID NO: 6790 - DNA, 1024 bp, Glycine max
  Soy_ogl_148 Gm01:43211501..43212524 Cluster 31
aaataatttaaataataattcgtgattgaatgtatcaatttataaacattaaattaaattatttttataatatataagatttaaatactagatcttatttaaaaggattaaaccaaatatctatctgagcaactgtcttatgctcaaaatataggttggattttcttatgaaaggggcgtttctaattgattctcacgggatatttcgattctatcgccaaatattgaattgaattacctgtcctccttatctatcatacaccctatcctttttacttagaaacgacacattgctaaaattaatttttttctctttcattacaattgaagttttatttcgataacttatgttgatatttaatgcatgctaacctttattaggcatattatcaaaataaaactccagttttaattaaaaataacactaaaaatacccaaaggaaactacatctagaatttatgcaaaatgaaataattaggtaataaattaaatgattttatcctcctacaaaagcaacagcacaaaatgatatctgtccacatgtttcaaatttggcttttgacaaaatcgaagagaagcatattttaggggacagtgtctgtctggaccactcacatcacgtcaaccaggttgcggcagaacaacaaattaggtcagaaatggatccagccacaaacatgttgaagacattgttcttcaaaaattcaattatcattttgctatatagatagatacatagccacatacccttttctggacctaaatcaaaacacttcctaataaatcaacaactacttacacatgggttatctagatatttttgtttattactttaggtggaagagtggagagtcacatcaatccaacccgtacatataatatgcctagaacacttatcaggacttgtttgtgcttgtcgattttagttttttttgcccactcaaatttaaattccttgcctcgtgtttgttgccagaaatattataaactgaacttggtattagtgtgatttatgcatataaa

SEQ ID NO: 6791 - DNA, 1000 bp, Glycine max
  Soy_ogl_2044 Gm06:40970601..40971600 Cluster 31
tgcatgttttgggaagtgctttggtgggagtattcaaagaagtttacctccccaaagacatagacaaattcacggctttcctcatagggttcatcattaaccaagtgcgcagaggctgtggtcttcaaaggagttggagaattattagcattggattcatagcgttgacttccaagaattcaacgagggtcctcttccagggaatagttaaacgagtctcatcatcatcttccaaaaattcaacaacatgaggtgactaaacaaacttttcataattaggttaattaatcaatggctccgttattcgctggataatggatgattaaataaatggatggatgttctgaattgatcttttgtttacttttttcatgcaaattaaatcatcaacaggataatatgataggttatctgcaatctgcagtttggaaccaaaaattaattcagaaactaacaagttgtttaattaatcactgatgggaaatgcaaaattataaatagaacgcatgtggttggcttaatttggaacggcagaagactatatatatgaaagtaattaacaatatattcatcattaatataaatttattaattttattagttatgcgtgtgaatagttaaaataaggttgtcaagatgtttttttatatactagactcgtaaaaactataaaaactctttttaagaaagaaaaaatttaaaatattaaaataattatttcaaaataatttaaatgatgatttgttattgtcatgtataaaactctaatgtattttatttattatgtattgaatattaaaaatatgacccatcattgaagatatatatatatcagaagacattttagattttttttatataaaaaagatatatgaacgaagcaagataataaagaatgattaatccagcgacgcacacgaatgaggcgatttgcagtggactttatttaagcagtaaaaaaaatttataaaaaaattaccttttttttttataaaaaaac

SEQ ID NO: 6792 - DNA, 1278 bp, Glycine max
  Soy_ogl_4611 Gm14:2558496..2559773 Cluster 31
gtttaaatccacatattcagaattagatcaaatgttttatttagaacccttttcccatgtgaattaagcaggaaaaaaatgatagcaggattaaaaaaattcaaattaacttatatagaacatagagaatgtgagaattcatagggaactcttaactacttgtggtctgcataagcttgaaaactcctcagcgctcaacatgtttggttcttcatcagcgaccctttgacagacactcgtaactccgaagctaccagacctacttcagcatgtttgagagattatagaatccgtgttggtttgttattttcaaatatgcactttgtatttggcgttgggataaaaccacctgacactttaaaagagtaactctttatcaaagtggagttggacaatgcgagaaacacgtaatattgaacctacttttttataaactttttctaaaaagttgtatattctttaaaacactttttgtatattatagtgaatcatattctgtttcttcttcttcttacattatttattttctgtggaacgaaatcttctttgtccttccaaataggtcaagaataaaaaatgaagaaacaaaatcaacaaagtgaatgaatttattagtgtagattacattccacttaagctttagccacatgacagtgtgtacctatttttagatatggcagttggtcattaactcatggcctataatttatttttggcagcctttggtttgcgtttggggtctaataatgatatacttagtcggtttgctgtgctactaccctgtgtggaaccaagcagcagctcataaaagaaagcttacttccgggtcattggaaaggaatctgacttgtccaaaggaaaattctgtacagttccacgtattttatttaaaaaaatacaccgagtggtataagaaatactattatattttacaaatcgaattatatcggttctaaaaaataatttttttatttagtctctttagttttcataaataaatcattcagttttaaattcgatcaatttaaaaccatttgaattagattggttttttactttgatcttattttactttttgggagaaaatagtaaataaatgataaaaatatatatatattaaaggataacttaaaatatccaatatctcatttataagtcaataataactaatagcagtttaactctttaaatatctactattaaaagtaaacttaataaatatgcatacgtacctttagtcaaatagttaaaaattatctttatttaaaatgtcttttt

SEQ ID NO: 6793 - DNA, 1098 bp, Glycine max
  Soy_ogl_6017 Gm18:10776901..10777998 Cluster 31
gctccttattagaatataggttagttacctattcggttaagagttagttacaaaatggttttataaataggagatcaattcaatatgttatcacatcagtatcaatatgttctttatctcttaacatcttcatctcttaacatcttcatctctttaatccatggattcttaacactgctagtattaatttattatgaaatgattaatttataaataaaatcagagtgactcagtgaaaacctagggaacccacaacacacaggtccttgaatcgttagtttttaagtttacacgaggttgctagtatgatacgatttatgtacaaacaaaaataaaagtgatgcagcggaagcgtggtgaccccataacccacctgtctttggttcgtttttatgtttacacatagtgctagttaatatatatattataatttgattaatgtataaacaaacataagagggacgcaacggaagtgttcttttttactaaaaataatttatttgctctcataagacatatttttaaactaatatagtaaattaagagataaaaaatagaataaattgaatttttcttataaaattatgtattttataaaaaaattaaatatatttttctatgaaaaaaatataaattattttttgtttttactaacaaatttttttagatccgtcactgcccacaagtctttgaatagttagttttgaagtttaatttacacataactgctagtattagtatattataatatgattaatatataaacaaaaatcagagtgacacaatggaagcgtggtgaccccataaaccataggttcttggttcattagtttttaagcttacacatggctattagtattaatgtattttaatgtgattaatttataaatgaagcgtacgtggtggtcccataatacatatgtacttggttcgcatgcctgctaatattaatgtattttaatataagaaggtttattatctttttaattcttaaactttttaaattatttatttatttttagtttttaaaattgtttagtctttacttttagtttattaactttttgtttcttcctatttttaatctcttaaaagagt

SEQ ID NO: 6794 - DNA, 1100 bp, Glycine max
  Soy_ogl_1892 Gm06:10305901..10307000 Cluster 31
agttgatatcaaataattaatgatactttaactttatcatgttggtgcaatcttgggcctttctaattatgtttgtgtactttgcttatagattctttgttaactgtaggttattgattgaaatatcgattttgtcatgctgtacgagcaggattgaatgaatttgcttataatctaatataaggctatccttctagcaatttagaaaatatttttgtaccatttaccttcaaatgtagcttgttcagaagcagaaagtaatttctggaaatatttgattaagtttaaatggaaaaatttatctaaaagtttgattacattactacacagcaatcaagtcaaactttggtagatgatgttcttaacaccaaaaaaatttatctattaggcatttagtacttcaaatcttctttggtacttctgggacattttttttaaagacaagttattgctactttcatctactattccaaaagcttgtattatgagtcttaatattttttttctcgagtttcatttggttcctaaatgcccttttcaacttctcaagtaagatgtaaattatagattcttatgtccctacctagtcagaaattcgtgcttcttgtttctatatgactctcacgtgagggaagttttgcattgcatgtgcattctctcctcacttctacatcccattgccacagaaatccatgcttcttgtttctaataattaacttgcaactgcatgctttattatgacaaggttagagtaaaagtatggtgcaaccatgttgaatagaacaatacttgtagaatatttggtctttcaatcatctatttttttttaatgttgtttatgtgcctctccctaaacacatggaaggaaagtacgaaagagaagaaaataaacctcagaaaagctttatcatgtctaatgctttgtgtaaattaatgatgtgcgtccttttaatttgaaccgcaggtattcacatttgggtccgtaccattgaagacctacttacctgatggggatattgatctagcagtgtttgctgaaaaccaacattcggaagaccgtctgatccaagatgtacggaatattttggaaaatcaaggaa

SEQ ID NO: 6795 - DNA, 1000 bp, Glycine max
  Soy_ogl_2070 Gm06:44103801..44104800 Cluster 31
gagatgtctccctaatgccaaagtatattacatacccttaactcaaatatccatttgtatttcaaaattagaattatacgttttttattagaggataaaaagaaaactacaagctgatcaaacaaggaagactctccacaaattcagcatgtgtttggcattgagtcaaataatttgttttactagtaagataattactatgagataaaaaaaatcatattttatctcttaattaccaatgtgatcatgaccacgccacatcattatcatgtcacccattcatatcattaatgtcatatgtaatatcacatgcaattcatgtttatgaatgacaggagagcaaaatccgtaaaaaaaaaaaattgcaagcaaaatccataatatcatgaaactatagggtaaattgtgcaatataaataaattatattttttattctttatattttgaatttaagtcaatttggttcttccgtgactttagacttaacgttgttaataatataatgataattaaaaatcgttacaaaataattctttcttttttgcatgtgtgtaaacatgcgtgattttcattccccttttgatccaagattttgaacttgtttcctcaaatttattgagggcttttagttactaaatcaatttcgtcaagggttgtaaaagtttgcataaaacattcgttgtgatttgggagatttttttaatctaattatagagaccctttcgtgaagaactggtcagtccgttttcatacttgatttctctcattttattatatgaatcttaaaattgatgagttactgaagatgatacattctatcaaaaagttctaaatcttgcagcaaaagatgcctaaactgaaagcagggtcggtccccactgaaagaattaaaaaaaaaagttagctaattagaaaattgttttattagtgatttagaattattttgttttctaggattggtcgatagaaatttgagtatgaaattttttatgcgtatga

SEQ ID NO: 6796 - DNA, 1100 bp, Glycine max
  Soy_ogl_2813 Gm08:36414301..36415400 Cluster 31
aaagagcattatcttctataaaaaaatttatgactaactatgaaataattgttgcagcattttgcaagaataagtgctacttaacaaatggatggaaaagttctagtaatactgaaatcttcattgaagaaaatattattcattttagaaaatataaaaattaatccaaccatatgcatatataatttaaaataggatgtctaattaaataaaacgacatgtttttatttttttacttttatattatatttatttaattagatgcagtttttctctgttgtatataaattatacatatctaacattttcgtcaaattttctttttaatgaatatcatatggaacacgtgttattattttatagtaatatgttaaatatttaagtgtttaattgcaggaatttttactgatatagaatcctttttctgtaatatataaaggttaacatatactcctattttatatatatacacaaaaattctctctacctcgaaattcaccggtaaattaatgatactgagtccacgggtgagacatatttcatctaatagaatgctgatgtttaaagttaacatcacgatggtgtttttgcatataattgaaactaattatttacaactaataggtgtagcttatttgacaacatatgctgagttgtgtgggaggatttgaatttttggaggtttgatccccgcatattatacttttaaggaggaataagaaatcttaagcataactaaatcctgaatcgagtgagtatgattattgttaataaaaaagaaactaattgtctataccaaaattatattagattatttgtcagttgataaaagttgaataacaaggcagataaatatattttaaaacaatagtataaaacagtcgtggatttttgtcaaaaagaaaataacagttgtggactaattgtaaaatatatggaaaagagccaccactcctaaagtcctaatagacgaataaggacattatatatgtgataagtctcatcaaagaaagaataatcttttaagatacttaatggttgcttcattgcaagttcgaatcgaccagtctaacagtccaaccagaaattcgacctattgt

SEQ ID NO: 6797 - DNA, 1160 bp, Glycine max
  Soy_ogl_5696 Gm17:15704141..15705300 Cluster 31
agtatatatacttctctagcttgttggattatattctgagtttctcacgttggaccatccttacataaatcctaaaggactggtacgtaattcaaaagacaacaagtttatttgtctatcttcttcctattgtccattagattgttttggctaaagatcttaaccaatcttttcatttctttttgtaacttttgtttgaaccaagagaagagctagtacaccaaatattcttgatcaagagccagtgttacttactctctgctttgtcgtcgttttacgacaatattgaaattaaaattgcctttggtgaaatggctgtgtaattatgtatgatgttggcttaaatattcttgtgaaaatgttatttattttattttagtgtttatttaattttaatcccaaaatttaataaaaacagtttacttttagttatttaccgtagattaaaaatatatgaacgtttaatttttaaaggattaaaccaaataattctacttctaaaaaaccgaataattcttaaaaaagactaaaataaaataaatgtaaataaaattaatttcaaaagacatatttttaaggaccaaaaatatgttagccttaaaatggttatttacattaatatatcacttcgaggaacaaaatctgaacgaaagattacaaggcaaatttggatatcactatgaagcaaagaactttaattgaaacaataatgaccacttatacgaccaaattaaaagcatcgacacgaagatatcgaaagaatcttctaagttctatccatcaggacccaacagcacaaattatagtgttatttatattatatgtaggaactatataatattatcgtttccattaagatttgactaaagattttgggtccagtttttgctagtggttcatatgtatttaatataatagataattatatagtatccattaccactcatttttaacggtaactaagtttaactgtcatagttgcaatgcatgcgagggaagaagagaagggaataagatctaaacacgcacaatatcccaatcctctactaaatgaaagcaaatatgtagtatatcatataccatgcttaagatgaagtcgttgcaaatctcgtagttgaagttatccagtgatatcatatattgataaagaaggaaaaact

SEQ ID NO: 6798 - DNA, 1067 bp, Glycine max
  Soy_ogl_6057 Gm18:17495134..17496200 Cluster 31
tattgagtgtttctatctagatatgccttctttcttagacaattatcgtgctcttgtttgtccctttttgggagtttttttttctgttttagtggttttgtatgaggctatttgttgctcacttgctccttttatttctactcctttaaaggtattgcaatattcaaatctactttaagaggcaatgagacacaatcttgaagttgttattggcgtcagtttttattagaaaccatatgtttatagtaacaaataatattcaagtgagggaaaaaatttcttaaatttctactttaaaatagaatgaagttgtattagtttatttatattagatcatatatttcaagtttaatttttaagtatcactaaagtattagtcgatctacacatcaagtttcttggctcatgagcttgcttgatttttttatacttatattttgggaaaatatggaatatttatgtcttcgtacgcttgtaggatatctcgttacctaactaaatataggattaagaattggtttttttcttcgcacctaacgccgagattcaactgacagcacagctcaaggaaaaaattatttactatctatcatggtgggaaggtagaaaattccatatttaactgttcttaaatggaggaacacacttagcactatactgtacctttatgggaacatatttccttgacgaaaaatcaattatttcttttcatttccctcttgcaattgattgcatcaattactattttttagatttcatattattggtatcgtggctttagttttttccttgtttgtttttgtctttatttttcatactcataaaaaaagtcaaatatataaagcatgttattattattattattaataaaaattaagtacagtataatatttttatctagtattataataaaaaaaagcgtgtaactcttttattgagaaaacaaaaattaaattaaaaaaacatgcattttttgtcataatcactattaaattgtcataataaattaattgacctctttccaagattcagaaacacactactagaaagggcgtctaaattttttg

SEQ ID NO: 6799 - DNA, 1000 bp, Glycine max
  Soy_ogl_6103 Gm18:48176501..48177500 Cluster 31
ttccgaagaaaatatgcacttacttggatggagttccctgtactggatgcggtgggtgttaggaatatacacaataaaaaagaaagtacaagcacaaattgttctagagagaggaagtacaaggacaaattgttctagctagtgagagattggaaaggtaaaagtgcaattggaatacaatataagtgtttattctttcaagacatccaagaataaaatactattttgtttctctttccagcaactttagtaatcattaaggggaagtaagaattttgttgtcacgtgttcaagcttaaaaagaaaaggaaaaagaaactatagtgagtgtgtgcataatcacaatttgcttattgctatacaaaattagaaaagattaaagtatattttttgtataattaaattgttattcgaatcatttgtaattcgtaatttcatcagattgttatttttattgagaaatatgagatgaaacttgtttttacagtaaagtacgcaaatatttaatttccaatgaggttgttaaattaaatttgacaataagttggttccttctaaatttttaaacacaatgtatacctcttcaatgtgacaacattccataggttaaagatacctcttacacttatttaagtcttaaagtgtttaaataaattgaactcctttgattttaaaaatatacaagtttgtggcttagactgaactccctttgtttttttgaaaaatagtctttgatactttatagattgtagatgtaatcattttaaaatcattagaaattaagtcttcaagatatgcaaacttgttttgaaagacatgaatcttaaggaaatatcacaaaaatagcatcatcataagttttaagtcatttgtatcttgaaagatacatgtttagcatactcaaaatatagaaacataaacttaagtgcagctgataagtacataatgagcaaagttttgttaaagatgagctacaaatcatcaacataagtgtcttcat

SEQ ID NO: 6800 - DNA, 1117 bp, Glycine max
  Soy_ogl_6112 Gm18:50171401..50172517 Cluster 31
gacagggaaaggaagatagagagaagaatagggtgagcaaggggagaggaaagaggggagaagggtaagttgaagatattaaaaattttgagggtgcaagaagcaaagaccaacttctgtaaaggcattatcaattaatagtggatgcatatgaaagaccgagtaaatagattagcaagatcgaagtaaataaacaaagtggtttttaattattagggtacaggttaagaagttagaagtaaaaatatttttattggaagatcaaatattatattgttcatgatcttttttaagtttctcttttatttattcaataaatatttttctcttttagttccttaatcaatacctaaaaacactaattaacaaggttttattaattttatgtttctctacaaaaaaaaactcagagaacaaaactaaagaaacaaataaataaaatttatattcaattggcaccggaagtgtacatagttaccatgttattttgatttgagtgaatttgaaaacaaatattttaagcaagattttcaaatttaagctttataaataaataaaaaatatgattagaaagagaatttctatcaaaaatgataagttaagttttctaataaaagttaatgatcgataaagttaataataacatgataaataaaagtaatagaaaggttgattttattggaagagaaaaaattttaatcaattaaaataaattaggtcaatttgatttggatatgaaaatttatcaactaacccaataaaagttaggttggttcagtttaagaaatcaggttgataatttataaatattcttagcatattaattaaaaaatatgaaggaaacaaaatatgcgagcacattcatccgtgggtttcttcttgatagggaaaaaaccgtgcatttgcctctttatacatgtctcacgtaatctcttacatcatcactttccacgtttgtgtactaagaatcctcttgataggggaaggtttcttagtatttttctagatccttctcatggtaatccgcattctcatacatcacaactaatagtctaagattttaatataagggatcaatataaaagatttacttcttccggacttaaacataagcatc

SEQ ID NO: 6801 - DNA, 1027 bp, Glycine max
  Soy_ogl_6368 Gm19:8247944..8248970 Cluster 31
gcaatcaataacagcctaaccgacgttgtaggcttgaaagcaaaacgatgttacaaatgacaatatccatgtaccttttttacaaattactccataaatataaacacaattattattttatttattaaaaataaaattatcaaatattaatgcatgtggtgggccttgtttgattgatcttatttcccaaagcccaaaaataaaaaaaatgcaaactttgaggcaacctacaatcacaatacaaacaaaaactataaacgtggtaataccccactaagagtctgtatactttacccattgttttgcattttctaaaaaaatttaaaataaggttgttgaaaacatgtttgggttcaaatttcggcccgtttaagattgtattttccacaaatagcaaactttaccttgtccttatgcaacaaaacaattataatttttggatttaaaaacataaacacaatgataataagcaggcatgttctactcatagcggttactcactacatatctacagcaagctagcatcattgttgcatgccaacattatgctctacatcatgattttaaaaacccatgtttgtgtgtgcgtgtgtgtataaatatataaaatagaaaaaaaaaaaaaaacgtaaccacttatgagttagcctaatttcaaaattagaatccaaaaccgtagtgtttgaaagtttaccgattcaaatattgtcattttacatacagtatcttttacctatattctatttttaactcatttattttttcaatcaccataatattactataaaatatttattaactttatctatatataacttattttcattaaagaatctgattccctgtctaatgttagatttctttttttaatcacgataagaactaaatttcactccaaccaataatatattgttccaacttatacatttttgttttgctttggttctttcccattaattttctggccaatggtggccacacaagcagtgagagttctgaatggacacttgcgaatctaatgaattat

SEQ ID NO: 6802 - DNA, 1053 bp, Glycine max
  Soy_ogl_6382 Gm19:31245901..31246953 Cluster 31
aaaactcaagttcaacattcgttgggttgagttggaaagcaaaagaagagagaatattaatatggtattcgtgttttcacaagaaaatgttaagattattttaataattcatgtgtcttatggaatttatggattgactttaaacaaataatgacttactgggatagttgtttggccaaatcttaatctgatagatataaaaataataaagtatgtggagtttttctcgtccaaaataaagacaattaagacatttgtgtcacaataattccgtcaatttattaattcacttaaaatcagtgctatatttttattattttcaatagtgtttacacaaattcacatatttttattttctagctagtattcatataatttttttttttaccaaagatattgtgttcaacattgtaattaatgaatatattcaactttggaaatacttgtgatatttgtttatttgctgtaattcatgtttgtaacgtttcttatcaatattgacaattttataattgcaaaaaattcatgttgaaccaaatgcggttgaaccaaaggtacgaggctcgatcatcctatgttgaataatgttattaggcttaactgttctaccatggacgcgcgatcaactttgctcgatcggcctatatgatcgggcgatctaataagtttaaataaatcaatgacagagctttgtcgggacagaggggtccatggttccacactctcttacaatttctttatatgtacaaagcacacatgaagaaataatagggaaccttttcgtttcttcatttctcaagtagtgtacattaaaagggaatagtcaacatgtaaatttcctttatttggcactagtggaaagacatgtccatttgttttcattttctcttatagtgtattaaaaatttattgttttacaaaaatataaaaaataaattatagttcaatatgaagagttatgaggagatatgtaagattgaatttaaaaaaaaatgagaaaatgagattaagataaagtaattgatagtttataacttctaaagtaaagcagtg

SEQ ID NO: 6803 - DNA, 1000 bp, Glycine max
  Soy_ogl_578 Gm02:33010201..33011200 Cluster 31
tgaatgaggcagaaaaaagggatcactatattggtgctaaaaatgtttgcttttaaggttaagcgtttatcatcgactaatgaacaatctagctggctagtttagtcgacgactgtcgactaatgtggcttaatttaaatggattttagcttgtcccagtgctgaagatgactgatgactaaaatagtcatttatgatggttaacaactaatagaatagtttcttacggctaaccactatttttgtcggttgaggctaacgactaagttaaaaggaacattttatagtgaaaggcacttgcaagcagtttttccacggctaaatggatacggatccatgatttcctaaaagataagagaaatggttagtggaagtggaaaacaacagttgtttgtttgcaacaaatttaggtaatgtgtggccacagtatcaaaaaagttagcaatgtaggaagctaagatcatgtaacatattatcaccctaaaatccagtactatggatagttattagaaaataactgatgtgcctagtaaatagttaatgcttgctattatcgttataaatagaggaaagccaaatgtaaaagggttgaccaaaatcaatcaaacttatctttttcagccaattatcctttgtttatagcccgtgtcaccactttcctttgccacttttagttgtttatcgtatttttttaccttaaatttcataagagtaatataacataaaaacttcagttgaatggttgctagaaagttctttgaaatgaactcagtatcgaatcaaagaacataatccattccttgactcaatcacctaaaaaacataatcaaggtgaattagacgacaatttttcacactaataattaaaaaaaaaactttttttagttaaactataatcaaactttaaaatttttagagaaattaaaaacatattttacccttaaatatattatgaaataaattgactttgcctgaataagaaacaaaggtttccatcaga

SEQ ID NO: 6804 - DNA, 1000 bp, Glycine max
  Soy_ogl_2352 Gm07:17023201..17024200 Cluster 31
tacattgggcgcataaaaaatacaatggcctttgagctcatgtattttttaaatgattttttttaatagaatgcatatattcagatcatgtttatatgtattacggaacctcgatactagatctattgactattagcatatttcataattcataatataactaatagttactaagagtaatcatctacaagtatacattaaacattaaacattttcttaatactcataatttaactaattatttatactcatacatttaaacctgggtcttaaatagtattgggatgtgtccataattttcttttagatttttaattaatataagtcaatgccaatctacgtaatttcaatattgaagaaatgcggtccaagcgattatcattctcagcagcttcaccattaaggcctttttttttcttagaggatcaagtaaaaggttcaaatttcactaaattaattttagcggattttttttataaaaaaaataaccatctaaaacgaacccagcgttaattttctatcctgcgtaaacctttcctatcattttaattatcttcttggccaatctaattgaaacaattttttttttctaatttcaattgagctagaactccttgagtgcaatcatgtttttgaattcttatagtttaaaatactctgtgttggtttctataattgtaaattgtaaattttataatttttttggtcataattaccgtttaaaatcgcataactattttagcattacaaaattgaaactaattagtagtattttagtgctttttcacaaccagtttcagttttgtagcggttgtaaaggattcggatataaatgcattagagcatttctaattagtgtaatttaaacaattcattttgaattatttattttatattaatggattcctataatatcacattataatttaacaactcatattttttgttcgggtatgattttaagcaactcttgattatgtcccctaaatgatccataaac

SEQ ID NO: 6805 - DNA, 1000 bp, Glycine max
  Soy_ogl_1880 Gm06:9514301..9515300 Cluster 31
tgaagaaaaattttatactttttttttagacccacatttttacgctttacttcaattttaatttttctttcattttaacctttatattttcatctcctaaatcagcctcagcctcgagatatatacacctaaatacacctaaataagaagtttccaacaaacattttccaatttgaatatagccaagtcaagataatatcgacctagagctttgctagcccaatctaacccttgatggcccacgagctgacccatgagttgctcactttttataaatattaaaaattcaaaattatcaaaataaattaattactagagcgcggtctttttttatatataaaaaacaaattatagtgtaaatatatatatttaagttggtaaataattatgatagtattgagaaaacaaaatgttgataaagtaaaacacatgacaaagatgtttctttttttattatatagcatctggagttgcaaaattgttttcattatatggcgacgcggaagtttaaaacattgtgaattatttaaactgttagttttaaactcaactagcttatgacttgtgcaagtagaatttcgcaatacttgacaatatttaaaagaaaaagaaaaacataaaccagttaaataaaataatttaatcaatttttttttctttctcttaattttcattttaatatgaaattcttttattaattgaatccttccaactactgtcataagtgattcaaaatgatgcacccttagtctaagaattttaattcaaataagggttaattatttatccaaaacggttgcatcctgaaataaacttccaatgtttgtaaaaaaaaaaaaatctaatggcgtgagacaatagaaatagaatatatagaagaatttggtctattaagaggaattaatctctcacaatataataaattaagattcaaatcttttttgaagagatcaaagatgcttatatttaattttcgatgtgtcttaaatatgattgtgtt

SEQ ID NO: 6806 - DNA, 1100 bp, Glycine max
  Soy_ogl_5331 Gm16:5933501..5934600 Cluster 31
tcaaacaacaatcataaccaacattcaaaagttcatattttgatcacaatacattaagatattcacatttttatgccaaaccaaaaatatattttcaagatcgcacattaatagaaccaaaacaatcaataaataacaaaatgaagttagctttccttaccaccaaaatagccaaagtcacaaacaagctgaaaacttgaaatctttagtgatcttccttcaaaagcttggatctttgaaccatccaccacctaaaacaaagttaataattccatgaaaagagaccaatatcagtttaagaaaagtgagatagagggtttaaagagaagaaaagtaggagagagagagagagaaattaaaataatgtgagtacgagggagaatcacacatccatttatagttgggagggggggagaaaaattaaaataataataatggggttgtagggtaaaatgctaaagacaaattgtaagtgattttgggacaaaataagcaaaagagtgtaaaagtttcttatagaacctatctaatgtgtatttaaattaatcacttgtcaactaattggtatcatttgcagtaattttacaaattggattcgaaatgagttgttgataggaaataagttttggaggtttgaaaataaatatgacatatattttggtctctatattaataaaatcgtgtttggtgcactgacagatagtatgcaaacaatgttgtttatgttaaagttataaaaatcagtgaatttcatgaaataccgattgaataaaattctaaatttttacaaagagtcataggatagagataaatttgccccaacccatcccacactcacccctaatcaatgtttgttgtctaggactttgcgttagcaaaactatcccttccatggcaagaggcatttaatatgttgtattaaatatttagtaaatattaatattattttaacatttaatatgttatattaaatatttaatattgtgcattaaatatttaatacttgactaaaattaatttttgtcttcctattttcttaaatatgtgattattttttaagtaagacatttcattcttgattcttaagactaatttcaata

SEQ ID NO: 6807 - DNA, 1100 bp, Glycine max
  Soy_ogl_6727 Gm20:33593201..33594300 Cluster 31
ataagctcgattagcttaccagagctttcaaacaattaaaatcatttacactctaattaaattcataacaatcataacacaatgtaacattttttaatagtacaatgtagctttttcttcattctaactatgcaatatcaaaatatacagatatgttagtccgcatcaatggatttttcttagcataacaccatttgcttttaatttggtctagtttttttgtttgtttttgtttcagtgccctcaaattcctccacagaaattaatttatttacttcgtttggtagtggggtttagagtgaaaatagaagggagaagaggaaaattttaaaaattagtaagtttcacacattcaacacattattttaatttaaatatttctctcatatttttattctctttgccaaatagaacaataacgtcttttttgactagtactagtgaaaaaaaaagaaaaaagacacgcacacttttgtgcttgtatatgataaaatgaaaaaatacgtgaaaggttacacttaatatgtggcaatgaaaaaagataaatatgggagatatagtaaattagttttatataccctgagtagttgcttttcttttaattatggtacagacaattaactatatgtgtaattatcaaggataaaaatatataaaaataacgtgaaaaccaaatagaattattagtataaaattatacataaaataatactatgttcgatcattaattctcagctcaaaagctaccctttcaagtcgtgtagttagttccgactcctagctagttgaataacaccaaagttgattcctcttgattggctatagtcacaagactcataactgttgacgcagcgaataacgagtgaagtggattgaactaccctaaacccagaaagctaaccgtcaaaattacaaccatcacgtttgatttgagttccaggatcccaaaacttttttcccccacatttgatccttcttcttttctttatcttgaggttttattaattaacctctgaattttaaaacttcattattaggcaaaatgttctacaaaaggtttccatgcaagcgaaggtgacccattcccaagtactcaaatg

SEQ ID NO: 6808 - DNA, 1002 bp, Glycine max
  Soy_ogl_161 Gm01:44400001..44401002 Cluster 31
tcagcattttgggctggcttcatcgggtcaagcgaagggctaatctttggtggaagtctgtttggtttgcagctgtgtggacgctttggatacaccgtaatgcagtaatttttaaagaagaaaattcagaactagaaaaaatggtggagttggttaaagtaagatcatggatgtggctatcttcaaaggctaaaggatttttggcaaaatagatagactggcaatgcaacctttattatgtttgacaggatgattctttttatatagctagagctagagtattttatgtgtttgaatttagttatgtagggaaaggtttcttcaatctttttatattataacttggtgtattctacaactcttgtatatttgacagagtgcctttggtacctgtgtgattattaatatatttatcttttgctggaaaaatatatttaaatggataaatattcttatattaaatttaatgaatttaactaagtgacaatcttcaaaagaaagaagaggaaagacaaggtttggacgtttggtatgtaaatgaatgaatgactcattaattatcaatcatcatccatggtggcgaggtgagagatgtaagctaaataagaaaagggaaatacgggagctacggaggagagagaaactgaaaatgagagttatgggggagaaatggaatacgaaattacagaggtgagagagatgatttttaaaattaaatatataaattactctaatatcctaaaataaattaattaaaatagaaagataatgattattttatcctaaatatttggatgtgtattgctaatgcactgaaaaaatgatgagttcatatattaaggaatagtaattttagaatctagaataataaaaattaaagagaaatattttataagaatcttgataaaaattaactcattttacaagaataacaaacatttcaaattttagaaagatgataaacaaagaaatatttctacatatatcaaaattaaaactcac

SEQ ID NO: 6809 - DNA, 1069 bp, Glycine max
  Soy_ogl_579 Gm02:36711501..36712569 Cluster 31
cgtatactgcaagatgcgttcgcatttctatttattttttgttttttttaatatctgaacgacagttgttttgttaatcagatttcatataattcaaatatatttctcgtctcgtccgatcaaaattagcatttccatggaaaaattgaagtgttcgctgtttgattatttaatttaataatcactcgtgtaattatgaaataactttaatgaaaaatatttaatgtgatgatagttagatttaaaattataattaaattattgggagttatttttaagttattaaaataactcatttcttctcattaaggttaattttaacaaaaaaatgaatttgaaaaaaaagattgtggaagttatcataaagataacttctctctcttctgaaaacacagaaaagatcaacgacaactttaaaaatttcaatatcatctgagagatcaagtaaaatcagaaaagagagaaatattaataataagaacaaaattatggatccgagcaagtgttctaaattttttcataaaaaatacctacagaatataataaatataaaatttatgttatccaagatcttccagtataatttcttataagatagaatcctaggaaattacaacttagagtcaaattatgctaacaatcggtataagaacaaggtttctgatatcgtttttttttttttttcattggagattcttttagtctgttctttttttcaattgttagaatattttccgttgccatgctttcgtattcagagatgtgattagagtcatgaatatatgaaaatgctctaattggctgagaatgtttttgcctgcgccgctgcatgtgaaaatgtatatacatgtatataataggattatgtgatagaaagaaattattatgttccactaatatgcacctacacgcgtgatttactaaaaggcatgttatgtggaaagttcttggatactttatattcatttgatggttcaatgacggtaattgaaaattcttatacaaacgcaccactaattggtttcgggtggttgcagttgagaatttgtttttacacgtgaacattaat

SEQ ID NO: 6810 - DNA, 1000 bp, Glycine max
  Soy_ogl_2049 Gm06:41300501..41301500 Cluster 31
aggcctttccataatacacttctaggggtgtattcaattagaatttgaaagaacaaaagaaatcaataatatcagatttttttaaatgaaaaacaaagaaataagttacacgaatcaaaattaaaactcactaatcatttttatatttataaataatactacgtactgtggtaagcttggaagaaaaacatagataatatgtcttccggtcttcctggataagatgggaagaaaaacatcattattgaaaaaagttagcggtacggatccatgtccggtacacattggtaagctgaaaacaatattgtttataattatagaccaatgtttactaataataatgtttataaaccagtcaattaattattggggccgtacgtgcgttcatcttcaaaactagaatttaattaatcagcagatattggattcacaatggatcaggctttagttgaatcaaaaagttacacgcaagtagaaaacgctgatgtgatcatttgggttgcatcttacattttcaaggatttttgcagaaaacctagagatatccacactttaacccgtttcatggcaatttgttacagttgactattacacttgatcaaacgtgtgggctgtggaaatagcagattgtgtcgtgaagtcaatgttaatttgttgtagtagctgaaaatttggagttggttggtttacgctggtcttactttatacactcttccccgtatcataaatcatagtaatttatatacaagttcgtgtttcatatgacaattaaatatcatttttacgtaagaaaatgctctatataagtcacctaaaagcaagaaaagtcacaccaatgtaaaccaaccaactccaaatctggcttaactaattaattaaacctaattgaactcgattcttcacatttcaaatacataaaattatccaaattacctgtccaatgaaagcaatttttttttatctataaatgttagtttttgtttgttcattttttttagtg

SEQ ID NO: 6811 - DNA, 1200 bp, Glycine max
  Soy_ogl_4768 Gm14:43956201..43957400 Cluster 31
gtttatcattattactataataattaagttgatcactataataaaattgtgtaaaagtaattgtgtttattatttttaactttttatgattacagttaaagttattatcttttaaaataaaaattaatttcaattttgtgtgaagaagagtaaatattttcttaaaaaattattacttataaaagtacacatttaaacaattataaaaaaaataatcccccttcaaaaaagttcttaaataatcccccttcacaagaaaaatttaacagtcacttgaataaaactccgcttcattcaaccttaggggctggaatatgttatctaaaagggattgtttacctaagagtaacattgcaattattaatgaacacctatgcctcaggatgattagctttaagtgaatagcccgtttagttgatgaaactcctgaagaattttagcattcaaacacaagttatattatgcatcggtagcagatacaattggggattttaaaatgtctcacattgatcaaaactcacctccattttgaactttgagtttggtgacaaaaaaattgctgttgatcgacttttaaccccaacaatgacaacatagtttttgaaattgatgaggtatttgaaagacctgttgaattcattcggacccctatccatggataaagcatttcattaggactagtgggccatgtgaagtagactacattggaggcattgagtctttcaagtttatcttccatttcaacactttgttcaacgttatatgtactgttggccctttgttttagcctacatggacattagcttcggttttcaatctgactctaagttgtgctaaccattttttcaacgcaacaaattagttttgagcattatagcatcaatcgtatggacattaatgtatgtctagtgtcaactttctcatttttgaagtcgacacgaaaacacaaaattcttgtagtgtttcataattaaattaagaatattcttaattcaaacgaataaagaaatcataagtcggagaacttcatttctgagagaagtagttatttaatataaaaaataacttcacaaaacaaattaaaggagtaagttaaaaaatttgaacttttctacacaaatttttaataactttgcccagaagaacttcacaaacatgttttccaaattaagaaatgatgatccatcggggccagaagca

SEQ ID NO: 6812 - DNA, 1000 bp, Glycine max
  Soy_ogl_5988 Gm18:7925401..7926400 Cluster 31
aactttcaagctctttgggagaatgtttaggtgctaagtgattgggacttcaaatattgtaaactttctctttgtcaatatatttatgggatgagtattgtctcttctagaacgaaaaaagataagcttatttgactgagttatcgagctaattagtttgggatttggttttgtaggggaaaagtagtttcaaattctataatttgtcttaacttcctttctttgatcctcgatcttgagcaatcaacatataatatgtattgtattttaactaggtatctccacaaacataaataaaatatatttaagatcatcaaatacatgaattaattgacatcaaattaatcaaattagcttaacagtaatcttggattcgaatcaaatacttgaaggagaacttttaaaaaaaaaatatttaagactattaatttctcccacgttgtttcaaactaccaaatttttcaaatgattaattatcttctccgaagtttgaactaattctcttctcataatataacttgcttaacatcggaccagctagctcttgtgtgtttctccataactctacgtggagagtttttagttagaatgttttgtcttacagatcattaagagatatacttttgttttacactagagctttgaaaatatattcttagacattgttattatatatgtatacaaaaatgtcttacagatcattaagagatatacttttgttttacactagagctttgaaaatatattcttagacattgttattatgtatacaaaaatgacatcatatgttttgtttgactttttttaccccacaaaaaatgaattcttcagccagcatttatttgcaagagcatttattttgacaggtccaagttgtttagaaattgtgtaaaaaaagaaagaaaaagaaaaaaaatagctttgatttccggtaacaagtcgtaattaataggtgggcatcattttaaacttttgtttttttaaggacattttaaacttt

SEQ ID NO: 6813 - DNA, 1200 bp, Glycine max
  Soy_ogl_151 Gm01:43496801..43498000 Cluster 31
agtatatataaacgtaaaacacgttatttaacatatatcttaatatataaatcgagttacttctccaatcactttccccgctgaaattagggtttaaattgtaattttgaatgctcatttctatataaccctttataatccacaattaactcctacaataaattatcattactagaggagacagccgtccaattaattgtagtctcttcgttatcagtgttatgtaatcttcgaaacattgtaacgtgtacatgcatggtttttaactcaacccctttctccctcgatcacttgatgcaaaagatcctctttcgatactcttcggcttcggtgttttttaagggcagaagaagagcctctaggatttgcgaggaggagtaatggctatggcaacccctgggcaactcaacgtgaacgagtctcctttgtggggttaaagaagcatcatttgtttcgagaagttggagctaattggcgaggacacatatgtgtcagtcttctatcatttctcaccatacccacttcttcattttccttaatttttttttcattatttgttttaattttatttggttgtgtttttctttgattgtgttggtttggtgtgatttatgggtttggacaataacttatgtttttttttcgtttgtatggtgagaaatatccatttcctgtatgtgttttcccatacatatgttacttatttttttctactgattttgtcaaattttgacatttaccaaattgaagaaggaagcttgcagcaggaaaatgaaaataaagatgagtggacaatagcaccaaggtaatatcaattaaaaatgcttttaattatagtcattttgctatatcatttttaaaagttaaatccgtcaagattaaagatgactacatatttattgtgatgttaattaaaagcatacatgtctaatatctcttggttcatggccttttttcattcacattcttactatctggttcttttattttgggttattaatcacggttcatttttggatgtcttatcctttgattaaattattttctaataaaatattacaacttggtttctctcttcctaagaataagagttttaatggcaaaatgcacctgatcgaggaagtgaaatgctttcatagccaaagagttagagttcttttttcttcaatcttttgcttttaaagtttttcaaacttattt

SEQ ID NO: 6814 - DNA, 1000 bp, Glycine max
  Soy_ogl_2099 Gm06:46925301..46926300 Cluster 31
attttattgcaattaaatcctttgagttcatagtcaaacacctgaagtatgtaccaaggaatttttttttcattctgtcttttcttgtttaccctctaagtattatttatcttattactacacctttagcataacaagatggtttcagtacgtaccaactatattatatatacagttaggctctaagttgctcaataaattggcttattcaaccaatatattgttcaagaacaatttgcatatgttggagggctagaaattaatacaagcaaatagggtatgtattttttaaataatttgagattgcatgtgtgacgagatttgtttagatatattacattctggatttaaatatatttgagggcttttgataaatcggctctgagatctaaacttgaaatataaactcaaactaaagatcaattgcttcaagccaattgatgatataagtatacaaaagtgccatagaaataaacaatataatataaatatagaatgtggtgattttagaaaaaaaatgattatgattatgatcagtagaaaaccaatgttcatttctttgctgattcttatcattgttactttgacagtgggtattacataattggaacgacgaggattgtgtgaaattactgaataaatgcaaggaggcaatacctaaccacggtggggttattatcatagaggtttagtttctatcattgaggtttatccatagtgatgacaataaacgagtgcaagtgaaggaccacactatacgtatggttgacattagaatctatatgtttctattttcatttaatttactttttggttccaatttatcttgtgttagaatcatgttcctgaggaaataaattgatatattatctgaattataaacctcatgcttactgcgtgacttagctatgtgcaactcttttttgaattagtctgttttttttaattaatcttgttttcctgagttatcctatttacgataagcgtgttgtttttgcta

SEQ ID NO: 6815 - DNA, 1212 bp, Glycine max
  Soy_ogl_2300 Gm07:8880201..8881412 Cluster 31
acttcatgtacagccattcatacaatgatgatgaaatcaaagacgtcaattatacatttagggatgaaatcagccctgttattgtgacagtgattacgagacctccaagcaaaagtgtcttcataatcaccataattgaattcaactcagctcctaaaatttcattatactttcaagaacagagcttgataacaaaagaatataataaaaaaaattaaaagtcctagtaattcatatttctaacggaaatttactcaataatatctcggaggtttcagtgatagttacgtttattggcccctacaagtattttaggaggtttcttctctagagcttcacttcgatcggttagacccctctgaccataacaataagcaaattaacacgctcgatcactgaattaattttctcttcaggtatattattgatttgcttttttgattctcagttttcttcttttctctattggtatattttcatgggaggaaagaaaaacagaggaaaaaacactgacaacttttatcagattgacttttacaaataaaaattgaaaaaaataatttacttgtccttcgatttaaattacaaacttttttcttctctttcactttctctgcactgtactaaacagaaagtctgggttcgtaccgctggctacaaatttatgataccatatacgtctgaattcatgcaaatttatgataccatatactgctggctacaaatttatgataccatatacgtctgaattcatacaactgtaaaaattaatgagccttgaattttagtaacatttcctaaaatcttcctttataaccattttaatactatcaagtatatatgttctatgaattggtgttactgtcgtctcactatataagttacgcctaaattcgtttttatgcaatatagagactttgagccaagaattgaagatgaagcatctctttgtattgggacttaaccgaccaaatttcttctgaagtattaccacacaatgcaattgggtaatcatgaatattagtttcactgtaacagaagttagttttattccttaaaaaaaaactggtttttttcagtatatataatatataataagacagcaaaggactagttaaatctaaaggtagggagacccatactgtgctagatttgtaaatattattattgtatattgatgtgatattacccctatttcaattgcatcaggtt

SEQ ID NO: 6816 - DNA, 1199 bp, Glycine max
  Soy_ogl_4325 Gm13:28444801..28445999 Cluster 31
gcttccgagagaaccaaagtcatcttactaaaaagatgatacatgattattttcatagttgcctctgcaaaatcaatttatcagatacatgaaaaccaaagaataattaatgcatgtgatataccaaattaccatgcttagggttccactcaacggttcttcgatgacaaattctaatccattggtctaaaaaaaaccctaacaaactaacatttaaaaaaaacaataagcgattccatgctagtaccatctccagtgtttgcttcacattcaaaagcacctctcacatcgaacacgccaatcacggaaatctatcttactaaatttaaatttggcattactgacgaacaactgaaatgaggagaagaaagaaatcaagaactgaaactttagtttggcagtgcgatttggtcatttttggatttctaacagagtcaaagactgaagagagaagaagaaagaaaacttaatttatccatcgggtccgacttagaagaatgatcgaatcatagaaagcaaagccaacttactattctcagttaatcagttaatttaaatgagcaagaaacttccctccgcaaattctcagttaatcattcatattttaaatatttcactaacatttcttatttctctttttctctcttcttatcattatcatgttataaatttgatcatacttagaattttttttttctatttctatcaaatcatagacccaatcatcatgccaaatatttatctaaagtatcagccacctaatagtataactctgaaagaatagggggtacttctacgtacaagatttaaacaaagcaaataatcaaacaaaaaaaaaacgtctccgtcgatggagcattttttactagtggttaatttttcctgctgcataatctactataattctgtcgtaagtgttatgaaaaacgaataaatatataaaacatcacgtctccgatcgatgaatagtttaaaaataactggatagtgacatggatatagttgtcctccattttttctatcacaacttcaaagttttaaaataactggattgtttaggtccttatatcatgaaatgacgataatgaaaaaattatatataaaaaattgatatccacttatttttagactcacattaaattagactgacactcgctttattagatttttttatgattagttgatttataaatatctat

SEQ ID NO: 6817 - DNA, 1011 bp, Glycine max
  Soy_ogl_601 Gm02:41880101..41881111 Cluster 31
ttttttttgtaacaatttaacgtgatttgaacaacttgaagcagatctaaacactcactaatagcagtggtccaaaaacaaaaaacaaaacttgttttttaaagttattgagaaggacttttttatggcgtttgtgtaggttcctttcagatacaagttacaactatctttttcgttttttctcatatgtattattacagtattataattctattcgattcagtaacttgtaactaacaggtttgaaaattcaaattacttctaattgagtagatgcacataagaaaatgtttgagtcactaatcaattcgtaagactactagtaccgatccatacatcgcggattagtaattaagcaataaataatgttattacatgcatgagctgagattgcaatcacgttttaaaattggttcaagactctgcatttaattatagatgcaaatgttttattttattctttaagtggatcgaattttaagctttttttgctgcaaacttttgtaagttgaataaaggatgataataataataattaataaaatagtactgtacattatacatggttacttcgacattgacccaactagagtttttgctggtctttgtttcgtccttttgtgacatctatttaaatttaaattcaatatagatcaggcatatataactatactccgaagatcttttccccacacctatgtattctggcattggttgtgtttatggtggatatcgaaggttgattgtgtgatcccccgtggtcgagactcgagggtcttgttctcctgtccttgtgttttgtttagattaagagagaaataaatatataaaaaaaaaagaatgaaaagaatacataaccaatgcctgaaaaaactataaatgataaaaataaaataagaaaaattaattgttttaatgcatgaaaaaaataagaaagaaagaatttaataaattatatgtaaaacatttatatactaattaaaatttttcattccattacgttttagtaac

SEQ ID NO: 6818 - DNA, 1591 bp, Glycine max
  Soy_ogl_2078 Gm06:44852581..44854171 Cluster 31
ttgtgcctccacattattaacttcatcttcatgaggtgaaggagtatgatcaacattaacaggtgaaggagaaggtgcaagatcaacttgaataggtgaatgagtttgatcaattggtgaaggtgaaggagaaggagactcattaattggtgaagaaatagggtaaattccttctggtgaaaaactaatatcttccattactttcctggaaagaaaaaaaatacagcaggtaaaactggggcaaaaattagaatttattaaagaatcagagaggttataaaatatcaataaacctcctctattattttatttctgtttccttcctattaagttccttcaaagtacttgtaaaacaaatgctagaaaaattaagtgtttcatgttaaaaataacagcatcatgaacctttagcacagtatatatatacaactgcacaaattaaagagtagctctcattgcccgattaaggataaaactacaaaaggattgaaaattgcaaccagcttggttcatgtagaataaaatgagtgcgacaaccaagaggtcaagcttaatgtttcattactccaaaaccatacatacaactgcacaaattaaagagtagctctctgttttgtctgtgcctaatgtttcattactccaaaaccatacattaattttaacacttaaatcactggtggaatgaaaacagagagaattacaaaaattctattttcaaggatatcatcatacaataaattcatgatatcatcatgtattgaaggtcaaccagtagtaaggataaacaaaaatggtgtcttatcatactcaaatagagaagcaataacaagaaatcaatcacataatggcattagattctagaaattaatgaactttatacaaaaccacaggattccatcttagcctcccccaccttttaaattcatcatttatgctcatcattcattcgatacagtcgataacaattcaatctaaaaaattacagagggggcttaaaatagagtagagttgaattcatgaaataccacaagggaaatatatgtttaatttattggagatttaaatgaatatgtaaggagagaatctcatttaatgttgtttatatcttatgtatttgatgcataaattaaataccagtaaattcattcttttaaatatttttaattaattaaagatatattaaataatttttgttttaaacagatattgtttttcaataaaaattatatttttgtttgattaacttgaacacttcacgtataaaatatatatatatataaatgttaataaaatttgtatatgataaaaaggaaaatctactatagtttttttatgttaaaacatgataataaatattgattgtaaggtatttttttaggaacactgtaaggtaattaataattataaaaagttattcattggattatgattatcagtgaatgaacttggctaaatatcctgattattgtgagaccaatttaatcccttattaatcatgtcgatacttacctaattattggtaggcttttacttcaaaaattgtttgtaaaagtagctagtagagccaaccgaactttatgtatcatctaac

SEQ ID NO: 6819 - DNA, 1058 bp, Glycine max
  Soy_ogl_6106 Gm18:48533043..48534100 Cluster 31
attaatatttttaaaatctactacactattactattaaaatttatcttatttgcaatagagtttaaatgcaaattaatatatgtaaagacagtattttaaaattttcttcttgaaaccaattacagtgcaggagtttatagtatatgttttaaaacttactaacaagtttatcattcttttaaaaggggtaagtaagaaaggatgtgagaaaaattttgccagctgattcatatcattgtgtcttctaataaaagggacattcaatcatgatgagtgaaaagtattaaaatgtaaagagaactctcatttatttcttttagaaaaaaaaaaatgttccaaccataagttagagaacaagcttgtttcaagataagtgttgtgatttttaattaggtgacttaaactaatgtttgttcatcaagtgttattatcaactttgtttaatttcacttgatagtctcaattgtatttcaagagtgaggagaataaacattttactgtgatgttttatattatagatcttgaaactacaatgcatatatatcaaaggtttggagtttttctttttctttttttttttctgcttaatttggtatgcacttgaaaattgaaaggtatgaatcatttataactttgattgtattatttattttacatggtgtttttaatttttcattttcatttttcaaaagaattcgattaatgagatgttttccatatactatacagtcgatcggtttttggtatagctgcctagacagttggtaaagtgtatatataccattactttttgtaaatctatcaatatcatattgcatatatactttttttcggtatttaatatacatactattaatctcttaaaatattaatcccaattacaatgatattaacgatgactttacatttttcacttaaagtataatagacaagaatgacatatacagttcaactttttccaactatttaggaactattatccctattgaatcatttacctgaacacgctttcctcctaataaatcttgttcaaatccattttgtaattttgcatttg

SEQ ID NO: 6820 - DNA, 1200 bp, Glycine max
  Soy_ogl_176 Gm01:46818401..46819600 Cluster 31
attaaaatcatttgaattctatcgttacttcataaattaatattaaaatttaaaactttgaagagatattcttgacaacagtgtgaatttgctaattactattttcagttccgggagcgcaatccagagatgtacttggatctcccaaccagatcactactggatccacttctaagtcacaagagaatgatctcaagtggcagcccaacaagctatatgagaggaatagatattcttgactttttgatcgattcttttatttgactttttgatcgatttttttttttactttttgactttttattcttctatttttttcagggattttggttctaagtgtctaaatattgattcctttatagtatttttattgtatgatatttgcagatttctttaaaaagttgtaagtaagtttgtactttgatctctgcctctggcataaatgtatataatttttgtttttgttttttatttaaaccctatttttctcttagcatctgttgtctcttgcaacatggttaagattgttcatggtcctttctttagtgttaagttttcttaccatcactttggttttgctatgtatagaatgctagcttatcttgtgcaagcaatgagctgaagagcattgatttgtatgtctgtgtatgtatgactgaaaataagaatatctatgttatttggtttactgtcaatatgttggagaagtttgaatatagctgacacagtcttcaatgatttgccatttctgtgttagatatttgtatacacatgatatgaatagtgagacctacatgcataaattcaagattgtgtttgatttaatatattttgaatggtaatgatggattcttggtgaatgacttaccaaattagtgcttattaacagctttcaccaatgaattcactttctgaaagaacataatattattttctcaatttctgtgcttattgaatattgattcatgtgggtcttaaattcttgtgttctcttgttactaacatgaacctataatgatacaaatcttgaagtttcaagatagcatgcttagtatcatgcatttaaatattcaggatgatgtaatattgattttttgtatgttaatattcaataaaccataggaggtaatttttggaacttgtttctacacctgaatttttctgttttggatattttttcctgaatggttttagcttcct

SEQ ID NO: 6821 - DNA, 1000 bp, Glycine max
  Soy_ogl_3056 Gm09:11177701..11178700 Cluster 31
gtatgaaataagaatcatgtgatcattaacttgtcgtaactttgtgggatgctaattgataccatttctctttattttggttccatgggcaattaattatgttacttggggagtacatcttgtacgtgatccaacttaggcaattaataatatctttccaaaaagattaaaaattgcggattacaaagaacatggtctggtcaaaggctatatatatgagtttgatggttgaaataagctgacatgaacgatgaaatttcatgcttagaatatgtcataactgtgagcatgcatatacaactcatggaaaccataggaagcaacatctttaatttctttttggggttagtttcgggtaaaactttcttttttgattcatttgaaacaaaacacttggagaatcttaggagcattctagattttgttctaaaaaaattgtagaagaagaaagaagaccgaggttaaattctcacgacatgtatttagaaatatcacattcactttggacttttcgtggagcataagacctatttttattttatttttggataaaaaagcataagacctatttttattttatttttggataaaaaagcataagacctattatacccttgaataaagcattaaaatttaatttttttaaagtaaattttattcgtgagctctactgtccatatcttcaatttcctttttcaaacaatatgtatatttaggtataaagtaaatttccaaataagatccttgaaaactaattcgaataattcattaaaattattaagattttattttaactttgttttcaaaccttttaaaatacaaattatttattaaactattataattaattttatataacagttttaatagatgataaaattaattcatttaagcagttttttactgactaattcatttaagcattattaagtcaatgttgatttattctattatttcatttttttttccgtaaaaaagcactaaagtagttatgttatca

SEQ ID NO: 6822 - DNA, 1236 bp, Glycine max
  Soy_ogl_4327 Gm13:28480065..28481300 Cluster 31
ggcatcgaaaagtctttttaatgcagttacataattagaacttatactcaatatctctcttaagttaaaattaaaataatcttgtatcaataaatttattaatttacgtgtttggcgatttcgacgtgcagatttacattataatttctctttgtccacaaaacacaaactaattatatattagttttttttatgtaccaaaaagcttcattttcttttatttattccttccctttcttggcaaaattgttagtggctagtcctgctgaaacgtattatgatatcagtgctatatataacagtaacaaactttgagatttatgtggcttgttttcatctaaggcacatggatttgcgcgttaagtcaagctttcgcaatcataacaactgaatgaggttccaatagcatcatctccggcctcttatagagtgttgaatgtcacggttgccagaaataaagatgctttaatagttgttttatcaacgcgtgaggagggtataattataaatcttcattttatttccatattaagtaattcgcactttatctaaaaattattcaaatcacaaaaaagggaattggttctacgtcaccgccatatcatcctaaaagattgattattactcttatgtgacttgtatatcaaataagatagttaccggcctttctcagaattattctcctttcatgttctcccaaatgatttgccatttattccatatacttagaaataatgtagaagacattactaatgtatcaagtttaatttatctggttttagttcatatgtccatgcagtggcggagccagaaaaattataaaacctgggcaaaaatttaaagaaaccgcaagtttgaatggttatatgtaaggatagcataagaaataggaattaatcgtaaataatacaagaatttggtcctacgtctatagggtaaaaccaatttaaattaaactcagaaaaaggcctcttgcaactcttagaattcaatgaatccctttggttaaactttcttaacaaaataattattcattgtaatttttttatgtttgattaaacttttttaagaaaaagtcgaagcaaaaaataagcagttgcaagcatatatgaacaataaaggagaggagttaaatgaaatttttgtcctaggtaaaaattcaaaatgacaagctttgcccctccttttaaacacataaatcttggttcctttcctctaacataacgaagagctccc

SEQ ID NO: 6823 - DNA, 1300 bp, Glycine max
  Soy_ogl_6379 Gm19:29997701..29999000 Cluster 31
aaaatctttagatgtacacttgccagcattgattatgaactaagcaatgtgaagaacttctctttcaactacgtaatgctttactggtaggaaacccacgtgagtccgggtgatggtgaagtggataagccactaagtcccatcggagagatttgggaaagaaaaatgattatatgcttgaatatgcatgcatgcccaacgatgatcacactatatctttcggatataattggttctaatacaagtatttcactagctattaagctcggagtattgcaactctccaaagttcaaaatttatggacactattgtaccaaaaaaaaaagttaatttaattataagaatagataatgtaaataatggttaggatagacatgatgaaatattaaatatatacatttttcagtaaaggaattcaaattttaattatgagaaattaatttctttagttagactcaacctctcttattattcattatcccaccattttaagcctattaaggtccactttttaagtgacatttgatttgattctatttagacattttatttttaaaggagttagttcaatgtaaattaagagcatctccaactaagttcttcaccatagtttttcttttacttttttaataatattttacactttcttataatattacatcacatttcttattctaaacaatccaatcaaatttttcttcaaatcaagaaatttactaaaatttctcaaatagacgccggaatgtgcaccgaaattcgtttttatttaagatatacaataaaacaaatattataatgttacttttgtgctataagccccatgaaaactgaagagcaacgggtgctctgcgcactaacccaaaccaagatgtgggtcccatacagtttctttataacgatctcattgtctttattgtgttattttttgtgtgcacatctgaagagtaattcgccattcgagttgctctaagagctattcttatctaactaagtcatgtggcttctcttgtattaaatatttatttttattatactatatttaattgaagatattttcaagataaattgaattttaagattatcaccatcttaatcaattctaatttgaatttaattttaaatttagattttgactcaccatatcaataaaattacattccttaaattttaatattcttttataactttctccttacatttacttagtactctttaatataatataggaaaaaaatttcttacaaatcatatttaattttatcctaaaccttaaattctaaacatcatgcatatttttaa

SEQ ID NO: 6824 - DNA, 1000 bp, Glycine max
  Soy_ogl_4027 Gm12:9314801..9315800 Cluster 31
cattgttaattacatatcatgtttatttccctcttttgtgtttagtaaaattagggtataagctagtggaagattttaaattataagttacaagttaaaaagttgaaagcaaggtaactaattgaattaaaagtgtttgataaattatgagtttaatgattgtgcgttaaattgtagtttgtaattgatgataatttaaaattacattaaattgttagtgcatgtactattttatctttggttatttaatttccaaattgaaaaaagtataaagattttaaataaattagtgagaataaaatgaaaaaaataatagtttgtaagttaacttattttcttaagctagttgatgtaatatatgaaaataaattaaaaattattaaaataagcctgtgtactaaacaaattctagttaaactagcatataattaagctaatgatttaacttatgaaatattagagcaacttaccaaacatacttttggagtagtattgtatgaactagaaagggcacggctgctttgcatgctccaaaaaccatacaatcagtggcgaagcttgagtaaatatcttgaggaggccaaactggtcaaacaatatacttaaaatcaatttgaagtcatataacatttgtgattcaaatacatgttatacaaattggttttatagtattgtcattacaaaagtaagtacaaaatgaaacacaaatattacatctatttaaactattgcttttcattcttgaagtaagtcaccaaaataatcaattcagagctaaaaaatttaactatttcttttttaatataaaatctaactaatcattttgccaaaataaagagggaaaacccaaccaaagtcataggtatgtatgaacaacaagactttcaataaatattttcttttaatttgagaaatcttagaaacttaatttgaaacttgtaaaaaagaatatatttttcccacacctcaacaatacatgcaattcctcgaatatctctaa

SEQ ID NO: 6825 - DNA, 1100 bp, Glycine max
  Soy_ogl_6079 Gm18:23111301..23112400 Cluster 31
aacgaacaaccaagcatataatcaactgggtgtatgtttcagcttaactagtggtctcaagtttgagtcctaagtataaagttgcactaaaaaaaatacatgtggtgtagaaagaagggggaaaaaaaaaacaatgacaaaacagatagcatgaatccgttaagtgtggatgaaaatggtcaaaaaatgcaacataagatatatgttttcaatcctatgtatttattttccattcaaatagcatgtatgtatataacaatgacaaaaccgatagcgtgaatcctaacctttaaaggggggtaaaaacggtcaaaataatgcaacataacgtatatttttaattctatgtatttatttgccattcaaatagtatgtatgtatcattgctaagtcaaaggacaagtacttgtaatggaagataataatactaacgaaatatgactttaagacagattaggtatacagattaggtatcacaaaaacaaatttagtacaaatttgaatttttttttagaatatataagattaaaagctgcaagagattttctaatgtacactcatttttttaatgtacattttataaaactacaacttaattatgttttaagaaaattgaaattataacttgctaaaatattttcttttagaaaataagtgaaagtatattagcaaatttcataagaatttgttaaggtataccacttgtttttaagaagaggcattttactaatttatatcttaggtgtttaatggtaaaaaaaaaattaaggtatttaagaaaattgaagttataatctattaaaatactctttttaaataaatacgtgcacgtatatgtacgctagaaaaattctatatatattgccttttcttgtgccaccttattttgtaaaattttattttatatatgagaaaattctatattcttcttttaaaagtacaattatcattgctttatacccaccacaaagagttttaattagtcaagaaaattggggaaagtatcattaatttgatcgtctttttggattgagaaaataagcgtgacaaaattctaatatttagatgttaaatggttgatatttgtgcgattaatgaac

SEQ ID NO: 6826 - DNA, 1066 bp, Glycine max
  Soy_ogl_2787 Gm08:22319101..22320166 Cluster 31
tttgaaaatatatttatatcacatttctataaaaatttacgttttcaaatcataatagtgtacttgtctacatatattgcaatgcattgatacatgatgatatatacactgcgtgtattattatgtacatgtaaaagtggtatgcatactagctttgtacaaatataatttaaaaaaaaaatacactcgcatgggttggtttatgacatgtcaaatggagtctcttaatcagttgaaacaatttaaaaaattaaactcataataatgtttgtgaaaatgttggacaaaaacaaaaaatatatattttaatttttatatagtttcaaagttcaaatataagtgattttttttcatatttcctatatcggaggtctagaagtattcctaacgaataatacatttatgtgagacttacaaacttgttattttctcaataaaataaggcataattaacctctttattttttatttgttttttttatcgaggacctaagattaaggaaattaacacacgtgcacactttaaaattcttcaggtgtatagagagaaataacatcttacaaattaagctttgtctataaattataatttttttattcgtataaattgaatataaatatcgaaaattttacaataatcaattaacttaactagatttcttccctacttataattgtgattgtgatgacaattaaataaactaattaaccgaaacttatgtaccaaaaaataagttttatttttttatactgctggtatatgaataaccatggtcattgtaacctacatatgtttggggagcttttgaggtttggggacttgtaatttaagagtgaaccaattaggttgttgtttctgggggtttaaaattagttcaattttcaaagaaaagaaaaattgtttacccttaaagaacataggcacatgcaatgccaccaaaatcgcatttagaagcactacaagaggattatttaacaacccaagaaaagattcccctaagactagaccttatttcccatattgatcactaatgctcgtcaaaaatattgatcactaattccacgg

SEQ ID NO: 6827 - DNA, 1167 bp, Glycine max
  Soy_ogl_6369 Gm19:8390434..8391600 Cluster 31
tatcttaattatattattgtaccacgccaaaccacaacaacgaaaaattaaaacacacaaaatcttttttttaaaagaaagaaaaaaaatacaagatggaacgagacacccaaaacaacatgcagccgtcgtggaggaaaaagaaaaaagcaaatgtgacaaaacgagctagacagcataatgaggaggatccactaattatgggtcattttttatttgaagttgaaggactatgaaagggattattgagattgcgaaatggagagggtgaagagagtcgagccatggattttttattttatctattttttaagaaaaaaaagggctaatgatttcattcgtaaggtcctggattataataatgtttataatgtccaaggacatagccagcagttccaataaataatcgggtctctttaaacttataatatctggattgagacaagttacaagcatgcatgcttagtattagctgcatattcccgccaccatatctcctagtatgagaaatatttcacgtaataattgctttaggaataaaatcatggtctttagattcaagtagttagtcgattaaaaaaaattataattagttacaaaacaatttatatgttctttttaataaatttgtcactaaaacatttttcacctcaaacttagtgagtaaaaaatattattattaaatttaatcactaatttttttgcatatagtggtcgtggagaaggttagtgttagctggatggtcagttcaagctgaactttgaactgtaatggttccgtaaatagcaatgagaaaaaagcggctgctggtcgtgtttttcgggactcaaatgatcagattttaccaccaaacaaacacgtcaattcgcggtggatttaacggtagatcttaataggggtggaggggttcatagtcccccaaatttttgtaaaattatagttatacgtatactaattgttttcttcataccaccccaattcctcaaattttaatttaatgtaaacttgactcaatcaatgcaaaagagagacaatttggtttttaaatttgtttttcttatttcaatttggttattttaaaagtttaatttaatccctctatctattaatttagtttaatttgatccttttatttttataaaatttaatataggtctttatttttt

SEQ ID NO: 6828 - DNA, 1000 bp, Glycine max
  Soy_ogl_5137 Gm15:47320701..47321700 Cluster 31
caacaaaaaacatgcgtcattttaacactcccaggaatgccctaagacttattgccttcatctaaatggacatagcactatgtgtgtctgcataactcacatgagagctaggttaacgtcttttgaactcttaaaaatcggcgtgacccatttcgaaatgaataaactttggtctatataaaagcaattaatggcatatatacggaattgatgccataacgaactaattcaaactatgtgcctgccctacacagatataccagtgttgtcttcattcatttcggataggacatagttgataacttaggtgatgtacttaattgtctataaaataaatcttcaatactagcggtgagctctctagggaggtttatagtctttggacgattgagaaaaccttatactagccgactcaacaactattgctttattttgttttaattaagaaattaaacaaaatttcagacaaataaacatccgatccatttcatcattagacttttattctctttcctaaatagtttttaaaataagaaaaagatatataaataattcttcaagtaagtattgatccccatgctagataattttccaagaattgaaaaatctttcaaatcagtccttgatttttttttaaagctaaatatttcattaataatataaaattaatcttaaattaagcacgagttgtacaaaacttaagactttatgcaagcattaatacacacacaaaaaaagcccaagtataagcctataaaaatgtgaacaattaatgtataataatccgtccttaattattagtaaaatatatcaatttagagactaaattgatttttttagagaaataagatcgctttatttcattcataattagaagatacatacatgttggtatatgtttaaaattctggatgctagcatgggatcttgctatcctagccaacgtgtttgtctcctattaaaactcactaaagagtttggaaaatgagaaagaaggact

SEQ ID NO: 6829 - DNA, 1122 bp, Glycine max
  Soy_ogl_4270 Gm13:25897101..25898222 Cluster 31
atttaaatttgaatttaatttttatctaaaacgagctactatgaagcaagaaatgataatatctgtcatccaaatcttgaaaaactatgctttttcatcatgctttatccaaacctaagtctgggttctcaatttttatattatagattcaaacataaaatgcttgcataaaaggaggagaaattgaacattagaacaaaatttcaaaaaatttagatcgatttaaacaattttcaaaatttgaaataatgtttaattttttattattgaaatcttaaaaattgaaaattgtttccatccattcttaattttttgaaattttgttctaatgtttaatttctcctctttaatttctcctcttttatatgtatgaatatataatataaaatttgagaatccaaaattaggcttgaataatacatggcaaagaaacataatttttttaagattttgatgacagatattattattgcattcttcatactagttcggttgagatacaaatttaaatcaatacatttatgtctcaagattgaaattatccatataaggaaatcaaaattaataaaaaaaattgatttcttacaagattgaaattatccaccttgatggtgctccaactaggtttctcctctacacaaactatagtgaatggaggatattggcaccctgatggtggccgtgcggtttcagacgttgatcccacctattttgcgcatttcagacctagaaaccaacaccaaccaagtcaccatttcctcttccaatgcacccttgttctcaaccttcacaccgtccaaaaaaaaaccctgcattgctgctatctgtagcagtgtctggttctgaccagatatgtcagtattggaatactaccgtgtgcaagaaatcgttgacaatttagactaggtcaactcatggcctatgaccttttctgtggagaccaagcttatgacacaaccacctgcacctttataaaacccacaaggccaattcagtggagaccaaggggtcatgaagtggattcaactaggactccccgtgattaccatatagctctagggttacccttttatgactactccttctatagtagtgtaagattaatagttaaatacatgtatg

SEQ ID NO: 6830 - DNA, 1073 bp, Glycine max
  Soy_ogl_1884 Gm06:9657701..9658773 Cluster 31
ttaaagaatataataaaatttattgatatttaattaaaattttgtaccacttataaaaagtttgttgatatttaaaaattcacaaattttaatgagttattactaaaatagattgcatacgatttttgttgtaaaaaatataaataccatatctatcaaataatttcactcaaactcttaaaatttttagatttttaaaaaaatttccaccggtttcttcctctttttcttgccgacatctctcaaattctgcttgttgggatttgtcttatgtgcatcaataacacgggtatgggtctgcacacatggggcttctaatcattttggttgtataatattttcattcttgcctggtaaatataccataatcattttggttgtatagtatttgcatccttatcaaatgctttgtaattctggtggggtatcttgctgataacaaagaaaatctcgtaaattctgcttaggatttggtagcacaaactaaaattcaattgatgttgaggaagcttttttctgaaatccatacgtggaagacaagccaatatttgtattgttgtgctagtggagtaatgtgtcaaacacatagtgggctgataaaaagctacacataatgctcgagagataatgtcattattagtgaagggataaatatagacaacaaaaatgaatctgcaggcttatttattgaattgtatttagcagattaatttccgttttatcatatggaatgcaatcttcatagggagcaagacacttttatgttggtattttttaatagctgttgtgtaggagatgcacatttgtaaactctgttacttgatattgttcgagcactacttgtgcttagaacattatttaataaaatcatttattagctttaaaaaaaagtagtttgcatgtttttttttagcttccgttccctttccaaagattgaattgaaaaagtttgtattggttttacttttttctactaaaaatttatcatttatttgttaaaatgcgaatgtttctaaaaattcataatatacaatcttataaattcatatagtcatttcaaatattgtgaattc

SEQ ID NO: 6831 - DNA, 1000 bp, Glycine max
  Soy_ogl_6077 Gm18:21342801..21343800 Cluster 31
ggtcatattgaaactttgatgcaacatgtacattggaatgaagaaaaaatttgaccaaaaactttggtagctctttagcctgattgtctgcaacatgtaaagccagataaacaccgaaagatcaccatttgataccttgaaaccaaaacaaacttcattaagcaaataaaaagtttcacaggccattgagcataagcaatggtggagaaacaaattataagaaaaggatagaatcactagtatatggaaatatattattataaacatatatgtttataattttgaaaaactaattgcaatagcagtaagatacaatttatgaactctagtaattgaggtgcatatgcttccctatcttatcccaagctaatcctctaaaattttatttggtagaaacatacataactacatagcctacgatgacatcaattttaatgaagataattttctatagaatggcccgaacaagttcacattccacagggtaatgcattgtagttctggaagtataggtcatatttgtaattaataataatgataatatctacttagtcttagttgccatcaacaaagagattacaggtttagttcaactattaggagaaataacgaaaagaaaagaaatttacccaaaaagaatgaaaaaaaataattaagattatacaagacaaatttgcaggtaggttagtttgactccaccccacaaatgtcattcttatataggcatgaatcaaaagcaatgccaataatagcttcttatataatttagataaaaaatgctttatggaagaaggaccaaattgggtaaatggaatgcaaaatctaatatatagacatctctgaatctcgtacatgtgcattgttcacattcccttaccaattaatttaaccaaatgccaatattacattacttaaataaataaaagaaactatcactcctacagtaaaaataatattagaataaaaattgaacatgtttgcaaaggataatccttaaaaa

SEQ ID NO: 6832 - DNA, 1162 bp, Glycine max
  Soy_ogl_128 Gm01:39978739..39979900 Cluster 31
actttcttactattcattaaaaaattcccatgtttcttctacattttaaaactctaaaccaactcttggcttccaatcaacattttcaaatgtcatatttagtacgctcattcaaaataaaaaataagaaataagaaaaaaaacttagcatgatcataatagtaatcagtaaaattagtagtttcttttaaaatgcacaaacttacaataccttaaatggaaaactctgcccttttctagcgtagacacctccttcctccgtgttgcattttattgcttccattttagcgtgtaaatccccttcttttgtgtggccaactacaccttaatcatcaaagagaggttgaagaaaaataattcatcaagtgtcacaacccatgtacgcttgctatcagtatcacagtctgtagtccgcacattgagttggcgggaaaacaacgcaagcttcaacgggaaaaaaagaagagccatgtttgagagagctagcctttagtgaaacaatgactttaagtgaacagatctcaccacacatctaatttggcggtgcttctttctctaattggagaatctccaattaccttggatgatagaggatctagatccttaaaaaaaatggtgctttaaatatttttaaattaattcttacacttttttcttcttcttgccataccactccatgttccttttttttaaaaaaaaaaaattactccaaaagtactcctaatacctcttttgtgaaatcattgaccatcgatcaacataatcatatatctttcttagtaatgcgtgaatttatgccattggatgtggatccgaaaatttttgtgttgttttaaaggtgaatctgtgtgttgaatgtgaatcctagatgttggagcaaatgcccacatcttttggaagtccatttatatattttggaattttacttttaggaagttattttgttacacaatctacaattaaacttctagaaatcactgtggaaattattaggatctataccggtatttggaacactaaaaattaattatcaattgctcataacttacatacctctcaagggcatcattctttagaacaattacttgatatcacaaaaatgcacatagaggcgtatatgtcaagaactagagtttcctcttaatttctcctttctcaccaa

SEQ ID NO: 6833 - DNA, 1000 bp, Glycine max
  Soy_ogl_4036 Gm12:12464201..124290 Cluster 31
cgtttttaataatatgtaattattttgcatatgattgatagtttctttcgtgtcaatctaattggaatcattggataactatcctgatgtatgcactacctactttacaaacaaaatagtggataaaaaaaaattattttttctcactaaatgttagtttcttataattttgttaaaaaagtcaattttagaaatttgaacccattacatcttttttcctttttctttcatctttctccacccattaaattaacattatatctccaaataagaattaaatataagattaattagcgtattttgtttttgattgaaaaacaaacacagagtatatatatcacgcattattctctagctctctctgtctctctggtgtattaattgagtgctataaggtgggctgtgtatgattgataactttatggtcaacattggaaaagcacgtactattttacgggagatcaatttaaaatgaagtcgttatcacttatggttagatttctatcaacaagaaacaagcgtgattctatggaaattaaatcttctttatgcccccaccaaatttaatacaagtaattaataagagataatttacttaacagcagtcaattatatatgtgataggattgtcaattggatatgtgtctctgaacacgcttagaggctgaagaggcaagcactgtgtccttatggatatgaaattgaccaccactataagtctataatctcaatctaacaattatgatattgccatgcatgtaacctaatattaattaagaggattatattcgctttcttagccgggccacagacagcaaaactaaaccttgcactagactttctttctcttttcttttcaatatattaaggtgaatcaaggaggccttaattatctattaattaattattcccttttatagaggtggtagggaccatgtatatatgtaaagagagtgcaagagggagagacaccaaataatgcccaaaccagaaattattt

SEQ ID NO: 6834 - DNA, 1000 bp, Glycine max
  Soy_ogl_6108 Gm18:48850701..48851700 Cluster 31
acttaatattcctgcaaaatatttgcgttatggaactgtaactatccttacccataaaaactgggcaatcatattcagatatggaacttttaacttcgttgtggagttggacagctttctccttttttcattttcatcaattattaactgatctgccacaaatttgccgtttctagcgtgtcaatgtgaaattgtagcctgtgagctaatcggaccaacatcttagtataaattagtattaaagtttgcttcttcaaaactgaacttctcggtaaatattaattttttctcaaacatacattttgagataaccaaatatgatttttgatttagtactatcataattagagactccccagtaatatctcaatgtatttctataaacttcatccatttggattaatttataattaatttttcaattaaaacttaatcacacttaaaattctttgtctctctttccaaagagtatatgctacgaaaattgaattcaagttctttttcacaaactcatggtattatcgactgagctacacctaccaaatatgatttgaaaattaattttactctcaaacttatttttggaacactcccactaaaaatccaaacatacccttgtaggttaaggttaattgattagataaaaaatagtctgattgtctggtcaaagcgagtaggttcacttatctagcgagtcaaagtgattctaagaaattaataattacaatttctacatttcaaacataatttcttctttctcaataaatttctaaacacgctataattttagaagttcctatcaataacaacatcggggcaattacaactgcatagttatccatgtttttggtaatcaacacgcagctattatcacaatttttttataaacaaaaacattacataaataataaaaatacttaaattaagcacaagttatatgcaactcaagactcaataaaattggtacacaccaaaaaaatattaagcaaatagttaattc

SEQ ID NO: 6835 - DNA, 1200 bp, Glycine max
  Soy_ogl_3096 Gm09:32022001..32023200 Cluster 31
ttcttaatgatattcataaatgtgtgccttcaaaaaatgttgaaaaataagtgaactcttgacaaaacctattatcattaattattatttacacttatttgatagttcattttagtaacttttcttcaaggatattttcaggtcagttttcatgtcaaatattgaaattaattgtctgatatacacccttttgtattttgggagtttggtgtgagtttgtgtttgtgtttttcttaatgatattcagaaatgtgtgccttcaaaaaatgttgaaaaataagtgaactcttgacaaaacctattatcattaattattatttgcacttattttgatagttcattttagtaacttttcttcaaggatattttcaggtcagttttcatgtcaaatattgaaattaagttcttatgtatcattcatatttgtctgatatgtttagaagaattaattaacttctttaatattgatccaaaatataatttttgggtcatctcttattaaggatggttaaggaactcgtgaactggtttaacataagtaaggcgtgaggttcattaattaaggaagggagggtgggatagagagattctttgaatcttgattttaggaatatatatataattgcaattttcatgtgacattgctatgtaacacaatttcttttttattgtacagttcataactaaaaaaaacctcaacctctccatcgattactccaccaaaatttcacatttttatgatcctgtccttcgcaaaaagacacaatttatctcaattcttaacagagtaaagaaaaaaaaaatatttgtaatttaaggaaaagaaacatgaccagtgaatttcacttgggtcacttgatgtcctccaaagctaaagttattcttcaatgtaatttacaagagtacgcttctgaataaatataacagtttctaaatataacaggaatgttcaatgccatcacaagtaacaaattaaatttaagcagcacacaagggcaaaactgtaagagaaagtgcaagtaagatttgtcttggtttgtttataacttgtggtatgtattcactttacaagcaatcattcaagatttttgtcaaagaaaagtgatgtgttttccttacgaggatataatagcaaccttttttgtacttttaactcagaaatagaatagaaataatgtatagataacttctcttatattt

SEQ ID NO: 6836 - DNA, 1200 bp, Glycine max
  Soy_ogl_143 Gm01:411801..42616000 Cluster 31
ttgaaaaatcacaacaataaaatattaaatcagttcattatattctacaataaatcaatttgtccgtacattacgcagagtctactactaattacatttacaattaaaaaccataaaaaattaccattcattgtattttacaataaatcagtttatccgtgcattacatgattctaatactacttacaattacaattaaaaaccatgcaaaaaggaagacttatacgtaatacagtgaggaagttggcatgtggttttggtgaaggagtaaaaatactttttaaccaagtgaatacacgttggaattttaaattcgaattgactagtttggccatgctgtggccatttggaaatgacaattatgtcaccacaaaaaatgctttctgatgttggttgttaaggatttttccagcgcaaagggtattttggttgttgggttttactgtgtggcaaagagaatagacaaagtcagtcggcaaggcaacaggggtttggttcgcgcgtgttgctacattgtttctcgacactgcgttcaacatcaccaacaccgtgaaacactgaaaccacaaacttcaaatcatatacatttaaaacgcagctgtttcattaaccacacacttccaatcatataattaaacgcatatgttgcataaaactactacgcaacacaacttctcaaattatatttaatgcataatttccttatcattacagataaacaataatagtaatatcaatattgaatgcgaacccaccatccataactgttacgaacatgcctttactaccttttcgcagaatgattttttctttttaattaccagggtcaaacatgacatttactacattataacataaaggacattcctgtaaatagcaaggttaaaaataacacttaccaaggtcaaataaatcattaatagctcagcattcaggtttcctcaaccgtccaaattttttatcataaatccaacggatctaaaacatcacatctacacctgaaccatttgttaacaaatggaacataacttttaatgatttttcttcacgtgaatcacatagttgatgcttcaccgtagaattttcctgcaaaaagatgttattttgaacattatagctgttattatggtcgatcactactattagaaactcatttactatttgtatcccaatgatgttcccggcaaaaaaaaaaaaaac

SEQ ID NO: 6837 - DNA, 1300 bp, Glycine max
  Soy_ogl_2822 Gm08:38850901..38852200 Cluster 31
tcaaaagcaatagactgatcaggcctgcaatgttcatgatggtccatatgccacataggtttcaatcagatcctcaactagttgggatcttagcatcttcacttaggatcagattggaaaattggatagatatggctgcagagacaaaaaatcaatattattccatatgtaaattcaagggtcctgtttttgtgtatctgttatgtaacaggtggctgttagttagtttttctgaacacattagagcactcctctctggctttttttggaccactttattgttctatacacctaagcatatataggtttgtccaggtggttggaaagcaaaaactcatgacctaaaatgcaaatttatggaaatctaaattctttgggttccgaatgtttgaacatagactagtaattcctccaaaagccaaacaacgaaaaaataaacctactttgttttttctcttttttatataaactttggttatcattaatatgtcactaataagtgtccaaaactcatggtcccctgcatttttcttttataagcacaactcgttgtaacaagattttattatatctgtgatgtacacgtatgattatgaataattttgtattaaaaatgatgcactaaacaatttaaactggtatgcatggtaggtaagtgtcatatctatgattatgtgatttaataggacaaaaatcaatattggatgttcatgagaaatgaatttatatacattgattagggaatgacactatttttttttgttttaaaattttcttattaaaacaagccattgttgatctgttgtgcagcttcttcttcagaaacgtacggcactgatccctttgtgctgcataaaatctagaacatgttcatgtcatgtattacttattatggaagctctgatctaaattgaatgacacaatgaacattccacggaagcaaaaagcaaaaggggcacatgggatgtgcatagtgcacgctaatcatagccaaaatgaagttattgtctgtgtgtgagtgaatgaatgtgtcacattttcagccgtgggataagggtcatgcgcctgcattacaggccaagaattttaacagataaaaagagtcttttagatttccttcaatgaaattattgacgaagcaaaaaaacttttggggggctcaaagtgtgatccgtgaatgtatattgctaaaatagctttttgtattcgatgatgaacacaaagaaatggcaaggcctatttgggatacaaacaaaatgatggggacaaaacacttttgtttttagttttcttatattaa

SEQ ID NO: 6838 - DNA, 1200 bp, Glycine max
  Soy_ogl_4166 Gm13:12554401..12555600 Cluster 31
tcctacaccgcaaactacctttgttctcattaaacaaatcccacctccatttggcaaggggagccatgttaaacaactcaaagttttttactcctaatcccggcccccttgacttttaggcttacaaataatgtctcaacacacccatgacactctcattctgcctttctcacaaccccataaaaaacccctttggatcggatgaccactattctcttcctcacaagggttgacaatttgaaaaagacaagaaaactagggtaaagcaaaaataatggaatttaagagacacaccctcccccaaagaaagcaacctatgttttcaagtacacaattttttggagtgtttttcaatgttagaattccaaatacacatcctactaggatgagtcccaatagataccccaaggaacattttagcaacttataatttaagaaatctgcatacctcattaccaccacaggatccactctaaatgctccaaacctacttttgaaaaagtttacttttagtctgaaaaccaattcataatatcttagaatattcttaatggtcactacttcaagaagtctccctaatgaaaatagtgtctaatccatgaagggtagagatccaatcggtactttgtcaatctagaacgttaccgttacacctcgaatttgcaacaacacggaaccctaggttcaatttctgaatcatcaaggaattgcattcgcctcgtggaagcaagaattatttttcaaattgggactcgcaatcgggaatttctaatcgaatcacagtaagaaatactgataacatgtctgttgaagcttatcccgtcacacaggacacaatcaaggtccaatagtcatctttcttatgttagatcaacgtgaaagcccaaatacgagagcatcgaaccccgaaatgcctttcggtcataacgaacacatagatttcgtataaaaaaggtactgcgcctgcaactcttcaccccgctaaatgcaattgtcgtgccatgtttagacgcatcaattatatcgtcataaagttattaccattctaaaatcggcggatgctaagacttaaaggtactacacctttttttttttttttatggcaatctttagaccatacatgctaaactattcacaccaaagctacacgctatttctatttgtgtcatgccacaatattttatgaatctttaatttgaa

SEQ ID NO: 6839 - DNA, 1029 bp, Glycine max
  Soy_ogl_2079 Gm06:44929401..44930429 Cluster 31
tttataatatgggaacgatgaaaatcaaatttaagattttgaattcaagttttatggatagaagaaatgttcaaagaaaaactccattgaaagtgatttggcaaatttctaaaaaattatcaatataactggtaaatatttggtatcaatgctttggtgataaaaagaatagatcaaacttaagtcttcatatatttacctcaactcaaaccaactagagtgacccgagtagaattttttaatcttaaaatattaaccaacataaatgattttttatttttttagaataaaattaaaaagtaaaatagaggttcaggaagatgaacaccggttttttttctacttattttaattcttttgaatatttttttaaaagaaattaatactttttaaaagggataatcaagtaagaaattaaaagaggaggggtaaataattctttgtaaggttaacatatatattaagtgcaagttgcaacaaggtatccaagttgtgctgtttagatgatggagacacaaaaccttaggacattatggaccacgaaatgttccttggagacatgcaaatcataacccaatgttaataatgtcaatacttaggacttgtttggtagttaagatacaaaagagagttccataggatacaagggagatgagtaaaatgaaattatgtcgtatctattatctgatgtgtattagataactgttagataacaatataaattataggatagagtagttttatcctatcctactgttttttttttttttttttatcatgatcacgatttgaaaaatgatatctatataaaatgataacaaggaattgcattgcataggaaaaaaattctaaatttcttcttcattggtgtttggttgtgtcagaacatttgttctattggatccataaaataggcatgaaataaaagctgtgacaaaaaaaataaatctttgggcttttgtattaaaatggtataatttttctccccataaattaccaaaattgatagaattttaaaaaattacgaaa

SEQ ID NO: 6840 - DNA, 1000 bp, Glycine max
  Soy_ogl_1294 Gm04:8422901..8423900 Cluster 31
gcttttctaagtagtgcttatcaaggatcctttatctggtgttgtttcaaaaataaattatgacctatgagataaattagaaaaagagtaggaagcattgcactgcgcatgttcaagacataaaggttatattcaaaacagaaacacaaatggaggtccagtgcactatctacagaatataaaatgtggttagattttagaaaagcgtcaacattttcgtaggcttaaaataaggtgctcttaagatttaatcaaccaaaccaccatggagacttcagttggttatatattatccgggtgaaagaacatgttcgttctcaataaggtcccaaacatgccactgaactgttcgtagcagtcatatatattttatctatactttattttattgtatttttctttcaaggggcatattattattgaagtggataagaacatctattatgctaacaataatgcaatttaacttggttgcttacacctgcgtttggtgttattttttgttcctttgtcttcattctaccttctccaaaatggttctttatagtcattcttgaaagtaagaccataaaaagtatattgttaaataattttatgtgtttctaaaaacaattaatttttttcacttataattcaacatatttatttagtaagatcataagaaggagttaaacttattttagttaaattttattttaatcattatttttaaactataattaccaggcactccacgaaaaactaaccctttataaatgtttacactttaccgtgaagaaataaaaaataataattcaattaaaaggcattctaatcttaatatcttattaattaatttaataacttaatttctaaaaagatctttaacaacaatattaagagtttatggcctttcaaatgatatataaagcgataaacttaaatttatatcattctgtatcaatataacttactaaattcttcagtaaaagacattataattttaacttattaaattgtt

SEQ ID NO: 6841 - DNA, 1127 bp, Glycine max
  Soy_ogl_3518 Gm10:43669274..43670400 Cluster 31
aaacttatctcaagccacttttttgtttcttttttgcttttcacagatcttgtgaaaactagtttctataaaagagtatttttatacataaagaaataggcaagcagtgcaaagaataaaaaagacgatgtaaatagcatccggagagaattgaccgagcttatgttgtgacatttaactgcatggatttcaaagttaggccccaagtttaattagttacgcaaaaattttaagctgattttcaaaacatgggctggacttgggtattagctcttgacctggcctggttgttttaaagtagtcatttaaaaaaatgtaattaagttcataaaaaattaaaaacaacaattgaccaaaaagtatattaaaaaataaaataaaaaatgatagtttaattatttatgtgatgtgctaaaatttaataataactgaaattattttttatcatggatacgaaagaaaaaatcatttcatatatatagctcacaaagtgactgttaaattaaatgcattgcacaaaaatctaacttttgtacataagaaaataaaattgagatgagttttgggtttgggcaaacctatattactaggcctggcttttaatcaccactactctgaagaatcaagacaaataacatggtatggtgacctcaccaccactctactttttctgtgcaattattactaacacgagcatggatgatgactggcaaatagatatcaaagtttgccaagtagtattacactattagtagtatctgatagtgcacgatagtattcattttgcacattcaccttccctgctttcatttctaagtgggcattgaaatctgttgatcctttttttttcatgtctctttaatcgaataataataacttaacaacagaaaattcttttaaatggcaaattggttgccacatttttgaagaattataatcattcaaataagtgggaaatgacataggaaaaggaaacaacaatgtacagggtaaataatgtgtattgtgtagtatcttcgtaacattgccattaccaaactgaaaaaaactgcatgtgaaattttgcgataaggaatagtgctactagtgtaaaacattgttttcaccttgtttttcttccaccaaat

SEQ ID NO: 6842 - DNA, 1202 bp, Glycine max
  Soy_ogl_514 Gm02:12354601..12355802 Cluster 31
taagatgatcatatagcaagagtaaatgaataagttaaatgacatctacgagctaaataaaattctcttcgatatctatatctcttgctcatatactattctatttcatgacatttcattcatttatatttctttatttcctcattataccttcatgtttgaccatagcataatcaagtccaacaacaatgttcttcgtctcttcaatggccctatattacaatgaagacaatttgaaacataagtaacacattatttcaagaggttacaaaaccttgagttagttttaattgattcagtaacaaagtgcttgcaataagcaaatagacaaaaataattaagacattctaactctaatttctgtcaaataatgaatgtagcagttccaaaaatgagatctacaattctaatttttatcagaagctttagaactaattatatcatcattactgatcaacattacaacttacaggaaacccaggcctttcaagtaatatactaattctttgatagtttggcctattcaaaatgcaagtaaaatgttttggattgccatttgcagcacaagaaacattcgattatatcattgatgcaaacttggaaggaaaatggagatggagacaaggcttcgaatacaagagtaaaattgaccaactatgctacaccaagaaacaccattttgtaatacacttgttacctatttcagtttgaatatttctataaggaatcatgcatatacaaatccaaacagacataatttggttatcttaacacctctgttcatacggagaaatcattaggtggttttgtaccaccacctggttcatgatcctgatcaatttatacatgatttgaattcaagtgtcgttaattgtttactcttaaatgaaaatatttaaacaaatgtcacaaaattggataggaccaaaagcagatggaactccaagacggcctaataattttttgttcacaagacttttgtgtgcaactttcaaaggcttggatgtcatgttagtttcagtaatagccgcaacaaatacaccaaaattagtacattaaaaaaaacttggataatagtttttcagctcatggaataaaaggttaaaacaaatgactgaagcagagactcttacatggcatttcaatcataaaatcttctatgtagtattagacaccaaggtggattttagataactgggtgt

SEQ ID NO: 6843 - DNA, 1017 bp, Glycine max
  Soy_ogl_585 Gm02:39978260..39979276 Cluster 31
cagatgaaattaatatcaacttattttttttcttttatcttttataactatttgcattcatgttattaaaaaaattatcttctaggaacaaaatctatttttttatgagagcaaaaataaatatttattcaaataaaaaaatttactttgtgctgtctcagcttggaggatagttgaaacaccatatgatccgacaaaacaaaagatgaagttccccaaatgatttcaaagaattccaccaaaactagttgctcccgaattaccaaacgatctcccacccgtgttgagcttaacaaaaggaaaattaggaggctcccaactattgtagctagcccccatagtgtgagttttctgactttgacagtgagtaacaatgtctgaatggagtgtatgaattttgcagcaaatatttcagaagctccaaacaatatccctgaaagattgaagcattatgcaccttccataagatccaataagtgactgcaaaaagagtgtcgctagttttgttgatgtttgataacaccccatcaatagcgtgggtgtgatagaaatcctcatcctcgtccagcttcaaggcatgccaaatatttcttgagaacatgatcaaaacatctacttctttatgaatagtccaatgatcatgtcttcgattcactcagacataatggttttgattaatctcccctaatcgtaacgtaccccgacatccaaggcataagaaatgactttgggatacaattttttattataagaacatggaacataatggaatttggaaaggaagaaagatttaaatatatttttaattctttacatttggagtaagtttgtttttggtcccctaaatttaaaattaatctctttagatctagtaattttaaaaatatttttttagtaggactataataggctttttcttttcttttcaaattacattattaaaaagatcaattttaaatgagaaaacaaaaacaatcttaccctaagtttaaggcaatgaaaacatatttaagatgg

SEQ ID NO: 6844 - DNA, 1000 bp, Glycine max
  Soy_ogl_1634 Gm05:30238401..30239400 Cluster 31
tagtatttttttatgtgcaacgtcttctttttatgttgagatagatacaattcattccaatagttgattaatttagtcattcattattagaaaataaatatattttaagtccttgtattttaatcaaatttggctaccgtgttatattaagaaattatttcaaaattgtgaggattaaattcattaatttaaaatatggaaggaaacttacaaatagatctattatcaagatacacactcttcctaattgtaagttaatttcttcatgaaacacaattatatggaagaaagaatactttctggagagactgattgtgctgtctgtcactctagcactcgtgttttttgtagagcctgtcttaagattcgatatggagaaggtgagaaaaaatagtccagctaattgataaggggcagctaaacatggcaaatgaaattaaaattgctcgtgttgatagtttgaaactgttcactattgttctgttttacaaatagaggaagtgagaaagaacaagggatggacgtgccatcattgcatataagcaaaaggaataaaccctcactggatatgtaacaggtagagccattaagctttaccccctacttaattatttgggttttgatactgtaaatatattagtgtgcagaatacctcaagagttaagacacatattaaactacaagatgtagagaatatagaggtagaactattaaatgtgtagaaaatttattttgatttgattcaagatgttgtctcctttttatgtagttcaatacttgatgttgtctccttagccagggaacttataacagtgttaggccacatgtctgctaaaggtgctaccaatgctttgagaaagttgccagatcaatttgtgcatattttcaggtagaggtaacttggaaactaggggatgaaatactctatggatatatctagtttttccgctaaattactagtgaacaatatgtgtatatatagtttggcttggctataagg

SEQ ID NO: 6845 - DNA, 1000 bp, Glycine max
  Soy_ogl_2018 Gm06:19626901..19627900 Cluster 31
tgcatcctacactgatactctctcgacaaatcccaccataaaatactacttattacattatcaaatcaaattttattgcaaagttcaacacctcattctaaaagtcaaagattattctagatccgtcaaattgaatgcctaaaataggtcaaggttaggctttgaagtttgaatattctgcggttttaatggtcccacctagggctagaatcgcaattttctgttttacattaagcaaattacattcatcagcccactataactgttttcaaatcctgaataaacaagactaagcattattccgaccaattaaatctaaccaacatctacacgagggaaacacaatgtaaacattaacaagagttttttttcccatcaatctgataaatcgtttcctataacacaaagacttttacatacctcttgtacatggggcctgtttggacaaggtattagtgctttagaaaacctttttactaaaaatatagtatttttttctaatatagtaactcaaaggctttctaaaagacttttactcttttagtcttgtatacaaagagactcacatacacagctagtacgtacactgtcattgtttatcagaactcacaagcaatcactcccagtataacaagtttttaaaagctgtgatgacatgtgagatgaattcatcagtttattcacacaatagtctcaatgcattattatcattgttgttaacaataaaatttcacttgatttgccattgaatggattgtttgttctaaaaacaatattatactatacaactaataacataataattgacatgtctcatgtatataaaaaatataaatcaaaattatgatacaaatatagtttaaaatgaattggttagtaggattaactaaattttttggataaactttgaatttcaaaaacaagttgaataaataatacgtaaaaatattgtaggtgcaggggagacaaatggttggattgacactatgtcaagtccaca

SEQ ID NO: 6846 - DNA, 1171 bp, Glycine max
  Soy_ogl_2770 Gm08:19799301..19800471 Cluster 31
ccttacaacaacattatcgcaaactcatacaactaaccatatgtttggaactgcatccgcatgccaactaatatacatattgtagctttaactttggatgtgagtagacgtgggtaaacgtggatcatttatgccaatccaattacactataattaactcagataatcaattatttgtaataataattaggctgaatgacccaatcttaaaatacaaaaacaagtagaaaggatccaaattggaaaaaaaaacgataatccagggacataattaagaattgctaaacagaataatttaacctataatataatatacatgctactaaaaacaaccatataatatacgagcatctattaaagcattgttttatgtaaagaaaaacacctaccttaaatgcttgatatatataggacctagcatcattgaccaatattaaaaaactttacttattggcaattattttctgcacttatatgattttgaattatttaaaatttaatgaatttaagcccaaaaaaaggtttgaaagcctctatatcaatgaatgccataaattgtgattataaaagttagtatttagtaagaaaaatagttatacatttaaatgtatcaaacatttttatgtaatgttgatattgacttttgataacagtcactagcaacacacacatcttcaattcttgttttttctacatcaaaacaaatattttgtgccattgtaaaattaattatgattttttcgctcagagattatatataaaaacttaaatgattttatatttgttatatatatgtaagatttttgttgtttagagcattaatggtgaacacaatttattagaatacgaagatggtaggtaaatacattgataatttaaactttcatatcatattttgaaatcgaagccttaattttattctttttaacatgcacatcaattataatacttagggtacaagagatacttgtttttgtactaagtgtgtagaatggggatgcaccccaatactattggacaagacatcaatggcatgctattgctaacaaagactcaccgagagtattaattaacaaaactgaggcctccaaattaaaccacaaacaattatacctatatgcaactactcaactagcttgtaggcattagggattttccttggaaagggtta

SEQ ID NO: 6847 - DNA, 1041 bp, Glycine max
  Soy_ogl_3108 Gm09:34949527..34950567 Cluster 31
acactggcagctatcatattctattaacttgagaaaaatagaagtacatattctattgagtgagtgtgtgtttggatttaaattaaaaatgtgatacgcgcgattctatacaaatttaacatataaaagtcagttgaaagtaaaagtaaggatagtaatacttctgtaaatatacatttatcttaaacgtatgtttaatttgtaatcttctactcaaacacccactaacttggattgaaccaagccttagtctgcatgaatccccagtcagcacaaatgggcgttttgagttttgacacccttttttttatctttaaagtggcaatttctaataggaaatggttagagacctaaattttaattgacttgtagagagattggctttgttttatatgtatccattgatatattaaaattttgcgtcacacttattagcgaaaaaaatattctttgaattacgaataatgtttggtgcttattttatatttaattgataacttataaaaaatttcatcttaatcttttttttttttttaaaaaaaaaaacagaacgatttctacctgttttgttcttttcatcatgttttgtctagaaaacatggagaacaagttgtgaaaacacattttattaaagatgctattgcaaataatgaaaagaaaaaagaaacttttgaaagcctatctctattcacccaagttgtactctctctgttgcacgaggcaacgtgacccatctagatctaacctctttaatttgttttttgaggtaattatttggcactattcttgacttttcatctatgtccaaatgtgtttgtaatcttttcgtttattgtgtagctgaccaccatgcaaatgtgtttgccattttctttttctctgttgtgttgcaagttatttaacttgggtaaccaaaacagatagatggaacataatgcatcttataggaaacataatatgctgttagacaccgtttaaattctttcacaatttatatgatcttatgtagaatgtactagtaatgcaaactttttgttttgg

SEQ ID NO: 6848 - DNA, 1200 bp, Glycine max
  Soy_ogl_4749 Gm14:29392501..29393700 Cluster 31
cgcaaacagtttgggagcaagattttgcaaatcctagcttgtgtctattttatttcgcaaattctgaatgatttcgcaaacaagattgggtctatcgtgtttttcgagtggagtaactggagaggtgcatttcatttgggttggggtcatttgggcatttaaaaaataattaacactgttagtaaccataattattgagggagtgtaaaagaaatatgatttgagagaggaaatgcgagtggaaatgagcgttgaccttaacaaacaagtgtaattttctcaagtacgtttaagtccaactaataaaataagagcagggtccaacagttctaaattaattcattgtcaatctaattgaatggttagtaaattcattgttttaatatttatttaatatttttttacctttattacattaatctattactcttttcagtccttttataataaatgactttagttacactaaaaattatttttgataaaaaaaataaaatcggagcgagtatcacctaataatgctttctggacatccaatactagtttatatcttgagaggaaaataaaaataaaaaacgtcaaacaaatatgtatattattaaaatatcatgtatgctaatttttcaacatccaacgatcaccaaaaagatcactatatatttttccgatgtaaaacgtatctttcatttgaatagtataccttttactatgttgtcgttgtcaacatttgtccttcaattcgttgttcagaaactccctgatttgtgcgaatttacataagtatgtctaggacaatgatagtcgatggaatttattcgtgcgataggatacgttacatatgtagtcagttcctgacaaaaagtcaaaatcggttattatttgaagagaattttataaaatttaactaaaatgtatccctagcctatatataccgtgccaaagcaaaacatctatcgtatggtgcgtgagtttggaaatgttggaccaatataatctgagctgcaagattcgttattaaaaaaatcaagggctagaatttgttgacagggccaccttaagcccaagcagtccaagaaagcctttaagctcttgaatttttttttagtactaatatatctcaaaaaaaattattgtaaaattatatctaaaaataaattttaattataatattacaaataattattaattttttatttgtac

SEQ ID NO: 6849 - DNA, 1000 bp, Glycine max
  Soy_ogl_5100 Gm15:40072001..40073000 Cluster 31
aggaactttgtcgatgacccatgctttcaatgaatgaggggtgacttctgaaaggaagagggagccacccgtgagatggaggtacacaagaagattcagaggaacttacgaaaaaaggtaaggtaatttggagttttcaaaattatggagatgctagtaattcatggagtgcaggaagcaatagtctttagtgcagaaatatttaattgaaaattagtccaaaacaaccgatggatctgggaattactatttgcagttcctgattttctattttcaccccatatcaacaatgatgcgtgctttgaagatagtataaactgctttacggtgtgtgtgaccttttaactttaacttatatcttaaagaaacatgacttgtttttattattaattttgattttttaaaatagtgattatttattacatttaaattaacccaaatgcatattccaaaaaaaaatgcatataataagctcattcaattcaattttctgtcatcaaaatgttcttgaaaaaaaaaacctcaatgtaatcagagccatataggttttccgtatgccacgcgtatttgtgaagttttgcggtctcctttttcctttgtctttatgtctttttagctttttttctgtcgaagcaatatcctcttctttttttctttcccattttcttaatctgatattttagattctcagattgaatagcttcatattttatttcattatctttctcacaagctttttttttcctccttcatcattgtccccattggctatttttcactgcgtgacgtgtgtaattaatgattccactgttaacattttttttccttctgatttgtaagaaaattagatgaactgaattagtctcaaaacaggtcttaactcagaaaaatataaatactcacagaatattcatggacaaagttgttacttgatcaacatggagtctaacttaggtagataagtctttttcgttggcagccagttgtgggtttttcctac

SEQ ID NO: 6850 - DNA, 1000 bp, Glycine max
  Soy_ogl_6702 Gm20:6661101..6662100 Cluster 31
gacattaaaatgatcattttttaacaaaagattttaaattttagggactaatagctaccaaattcaagtactaaaaaactaattaaatatatttataatacataaaacgttgtgtatccatttatgctatcaggggattctcttcctatgtagtttgctcagtatctccaatcaatgagattcaactgttacatcctttatgcaaattctctaaacaacgacccactcactctttgtacaaaccactgcttaaaattcttcactgttgcttttatttcacgtcctctttctcaaattaacgagtcttttaagatcatgcatttcttcaagtacatgttctataaattttcaacagaataataaaccattttccagaaaaaaaaaatgtttatatattctaacctgattagttcaaaggaaataatggagtggatgaacatgtaaagcaatttatttatttttatgcaagcattgcatgtgaaataattgtatgtataggcctaccaaatttaattttttattgttgaataaataataattcatacaacttatgcattcttgctatgttgaatattgcacatttgattggcttcagttacacggcaacattgatctagatagcggttccaattttatcttgtaattaaagattttcattcaagcaagttgaaagacagcttctctactcacaggatctaaaagtaacccgaacatcttttcatcttttcgaccttgtataggtttaatgtataaaagttgaactgtgaaatgttttcagttagcttaaacttcattctcattttttttgtttccccgtgcctcctcctttaagagacaattctttttaagacaggactagacactaaatgtgaacatatctttcaatagagattcacaccttggtttattacattgtggatccttccactaggtccatctccttttagtaacttcagtctcatttaaacaattctttcttctatccttcttttgtatcatt

SEQ ID NO: 6851 - DNA, 1127 bp, Glycine max
  Soy_ogl_6709 Gm20:24326103..24327229 Cluster 31
ttctagatatgtgggcaatgggtgttataatggtttagcttttctctcttcgtcctcttttcccaggtgaacattagcttctcactccccctccctcccccatcctaccgaatgaacaaatgaactagataaaaaactataacaataaaaaaaatgctcggaccaaacacatgtataaagttggttctcgaacttttcctcaaatattaggtctccttttcctagattcaatacaagaaataactgaattacctatacaaaattggtaggtttttttaagatcaaattggtagttaatttatagtaagaaaaataagagctacaaattagtatcaaaaattgatacaaagtcgtagtaacataaaatgtgaaacaaagtaattaggaaaaaatagttaaaaaattaatttatatctttgagtctgttggttgcaactaactagacatacttatacacttgttgctgaatataaaaaaagcacattttctgggaatattgtttggattatcattttctattttcccccatttacctttcttgaatctagggatattgtttctgatactaaatttctgtgatgtcctcatgcttgctggcaaattaggtccctaatgcttctccaacaacagcttttgcaagttctgatatgtatggagcagcggttttggatgcatgtgagcaaataatggaacgcatggaacctattgcttcaaagcataacttcaacttatttgctgaggtactcttgtatttttagcttttgtttcttagtctaggtagttatctactcataataaatgactatataagcaaattatagttcaatgtatttcatgtgagcaaataaatgactatataaattgaatttttatttattaataaaaagtcaagttcaagcacaagaaagcatgcacaatttaaaatgcaagttaataaaacttaaatgctagtataaatataaattataaaacaattacctttttatttattaacaaaacaattaagttaaagcacaagagaacatgcacaatttaaaatgtaagttaataaaaattaaatgctagttcctttagccaaggcccaatagataaaaatagtgatttaccaaggccattgatttatgttg

SEQ ID NO: 6852 - DNA, 1213 bp, Glycine max
  Soy_ogl_144 Gm01:42732488..42733700 Cluster 31
ttgaatcttatgcatagttatctattaggctcagataaggagcatattaatttttcatcaatcacactttctacatcagaaagatttagaggctgacacctaaaataataatttgatttcaaagtttgtgctagttaggaggactcgtaatctaaaatccttcaatactatcttgcaaggagcgctaagttgaacaccctagtagaccaaaaccccagttcaccattgtgttttggatgaaataaattatcccagcttagccaatgcttttgtccttgtatcaaacctctcttccccaattttattcttgacattatgcatgcttttaatttgatagcgcaaagattatgccgatacaaagtagcccataacacaagagggtatagattgtactagtgcttttgttagcacctttattcccgctaccaaaaggactttgtccctctaaccatttagtttcttccacactctatgccggacaaactgaaaaatgtacttcttggatcttcccactaaaaagttggaagacccaaatatctctcatctcatgacttttcacttccttcacacgaagcaaccttttaagggcattaattttgaaattatatttaggcccgaagagatctttgatttgtctaagtttattttctgaacaaaagctaattcataggtcttcaaaatgtctgataggtagatcacttcctccatggcaacatgagtgaaaataatactatcatcagtaaaaaaaaaaaaaaaaaaacgaagtgaaataacaagagctttgggaaaaatcttaataccgtggaggaacttgagaaatcagaagggttgagaaagttactacaccggataacaaggcaacgaaaaagagtatcttcttatctcaagcccttttgggatagaattccttcggtggttaactgtttaaaagaaactaaaaaagtcacagtagtgacacatctcattattttaatccatgtcaacagaaattccatagatcttatcaccatttctagaaagctccactccactctgtcatatgctttggacacatctagttttagagccatgtgtccctttcttcttgacctcttgttcttcatgtaataaagaagcattcaaaagtgagaaatgcattatcaataatctattattttgggacaaacacactaatgatgcctggtaggattttcttcatcctactcacaattgt

SEQ ID NO: 6853 - DNA, 1180 bp, Glycine max
  Soy_ogl_866 Gm03:32869221..32870400 Cluster 31
aatctaacgtgccatgaaagcaaaatagtgtaagatttctgacccacaatgtcatgcacattgtctaatttggtttaactatctaagcattgatacttagttaaccctcggaggaaactattgtttggagatggatgcttgttagtgaagaaagtaaatagtcatagttcaaacttgggagaaagcatgtcttctggtaaaaactattgaaatctaatgttttgtaaaattataattatgagatcttatgctagtttatatcgtaaagctagtaagtagctgtttggttgagtacgtaattaatttcaacagcaggtgaatcatggttatcttggtattagatgtgtacggaacaacatttttttcctcatagaaccaataatgcatccccgggtctgtgagggagaacaagattctacaactactagcaaagttatacgatataataatggagacaaaggtagcataacatttaatttataattggtgctacgttttaattagtttaaatggaacaagatttatatgggattaattggagtttattgagtatgttagcttatacaatgtcataacgtgatacacaacagagacatttgcaattcgatcttgagcagcttcctattagaagattcgacttgaacttttgtttcttgacagttacaaattgagtgtcattctattgttaaatggcttatttttgttcgttattattaaatggcaacaacgacctctatatgtctcactctcatagtaaacttaggcaatccctctcaaaaaaaaaaaaaaaacttaggcaattgttatatatacctcccttaactattagatgtaactccctctcaatttgaagtatgctccaaacaaattatattgcctaaacttacctttgatgcattacttaagatcctatacgttttgttattcacaaagcccatactacaatttctaaccagggtccatccaaaggagacatttatatcctgcaccttgtatttcgcatcctacacctcccaaaagatttcaaaggacaaaaacagccctttactaggcaccttgattctgaaatggctattttggaatataattttttgtattctagagtagatttctgaagtgtttattctattatgaaatagttgttctagaaacatatcctattcaagaatagttgttctag

SEQ ID NO: 6854 - DNA, 1100 bp, Glycine max
  Soy_ogl_2794 Gm08:23206301..23207400 Cluster 31
caaaaacataatcatgagcatctaacaactcttctgttgtaaggtttatatttttattttttgaaaggcattattgtaggtgattttaaattgtgacatctcctgcattgaatcacagcatgatacaatacagttctagcaccagctcttgaagttgtgccactaattttgtcgtcagcaacgtctttatttcatggcaacccatcatttcaaaatgcatgagatgtgagaacacccacgtcgagacaaaggtccgttttggatgctagtgcatgagaaacaagaactggataaaccaaagaattagaagaaacattagatgagaaaacaccacataattaagtatacccattggttattgttacgtaaataggtcaattttttgcaatctccaaaccagaaactcgatgattaaactcataacagttttccacgtcttcttcttcaagttgacaatcacgaagatcgagatattgcatattgatcaaaccggaccatgcattctaatcatgtccttgcttttgtcctcgtacaggtcgtagcacaacaaagaatggtctatgagtttatccactatgacatgtcccttatcaaatcatttcttgcaataccatctggtaagaaacatttttgcatgtccttttcaattaaattatcataactacgttttaataccattaagacttcttcattcatctgttctcccatttccaatttgtcaagtttattcaatggatgtcgtttctccctttcatgatcacactgattccaagtggtaaaccgtcgtcggatttcattgcaacaaatctagcaatttctagtaattgagggggaagtgtttcaggtgttccacaatcggaaacagacagtactttctaaagaaaaaatttggtctgttatttctttttacagtcaagttttggtgtgttatatttctctttctcagtcttttgcacctcccattttttctctttttttttaatagttaaacattatttccatagtaacaagttgtgttttcttttagttggcaaaatagtgacaaattatgttgaaatcataatacgaaatacttgatatttaaagatatttaacaagtg

SEQ ID NO: 6855 - DNA, 1000 bp, Glycine max
  Soy_ogl_3403 Gm10:7187501..7188500 Cluster 31
ggaaatttcttacaaagattactagaacatgagaaaaataaagcatataaattatacgtataaaataaataaataccaactacctcaaagtaaaaaaataaataaaatcatgatgataccaactaccaacagtacaaaagcaaaagcccataatgtccataacaatgctgttgatagtcccttttgccacgttgctttctttttccaagtcaaaaaatattaaatgtccataatttctcaaatatggctacatgttcatgaaatataaaaatttaaaccataacaaaatatttaaagcatttcctaagaaaaaaaaaaacttctcaaacacagactgagacagtgtgttagtgtttcaaagaaaccatatctcaaattagaaatagcatatgagatggccaaagtagaggaggtttattcctcatattttcatctagcaacaatttttcaaatgtttattttactatcagaaagtactgattcttatcaccgacaaaagttagtaccagataaatcactatcacatttacatatttatttgcatcttatcattgacaaaaattggtctaagaagcacatatgtctggtaataattatacttaaactaaatttatatattgctcttagccacactaaactatgcaacactcaatgccaaacggaatgaaaatgctaatatcttaaaaatcaaatagcatatcaagtcaaatgtgccctcaaaatttaataacataaatggccagggggagggtgaaactggaagaaggtgaatgaaggttttgtgagagaaggggaggcgtgaaaggagggtgaactaagcgagaaagaaaggggaatgggaaatgaggacgttgtatatgacataatttttttaacagaggcaccaagcttgaacaacaaaattaacttgaattagatgctaaattccttgctttgagtaccaaattataaggacacctctatggatcataaattcagcatctcacacagatttttttta

SEQ ID NO: 6856 - DNA, 1000 bp, Glycine max
  Soy_ogl_3416 Gm10:9997601..9998600 Cluster 31
cgtataataatctcaccaatccagtaattattttctttgcaaaaccatattaagatcatacctcctatctcaaacagtagctcaacattttcctattaacactaagcaacgaatagaaagcaaacaaacaaagagtaagctcctttacttcaaagagatgctaaaagatagagtttttggaaaatgacaagaggaagaaatttagctctttggacaaggtcttgaataaatcatcatcattaactcaataacaaaccatttccatgaacaagataggaaatataaatggttaattaggagaaacaaaaatgttcatattttataagaaaaagggaagagaaggattaagaataacttaccaatattaagtatagatcaagccaagaaaagaattaaattttctagttttgaatactccttgaactcatgattatgaaactgaagtgtgtattttaagagccaaaagaagaagaaaaatgaaggataaagaggtgccggagactttacagtagcatgaagaagaataaatgagaagctgtgttttgcattaagcaatttataaacataaatattttttttgggtaacaaggaaattgacccaagtaaaagcaacgtaacaagttcccttgattttcaaagtagtgtctgttgtcagcacaattcaaggataaaatctttgaattttgggtcatgccggtttaagaaataaataaagttctccttccctttcaacttattcattaagaattgttttacttctgcatgaagaagtttatcaccaccaaatttctctacatctgtacctcctaagtaagttgcaccacatatggacaaatatggatgcgcctagtaattgtgcaaatggtggcacctcctttataccatcttactttttctctcagcggtagagttataatatttttattaaatgcatttacttatttaaaaggcacctcttgtaccacacttagaatcgaggagggtgtttgcatgtggcttg

SEQ ID NO: 6857 - DNA, 1100 bp, Glycine max
  Soy_ogl_4744 Gm14:28719601..28720700 Cluster 31
attagaacagtgcttcatggtcaacttcctactgatgaccctctgcataaaaaaggttgcattatagtttctgtatgtggtaattgtggtgctgattttgaatcctctgatcacttgtttctccattgcccctttgctgttatgatgtggaactggttaggagatgtagtaaaccgtagaattgacaactcctccatcacaggcattctgtctttttataatgttggctggtcaccacagttgagggatgttatcttagctgctatcatttttattttttggggaatatggcatgtcagaaatcaaaggaggtttcagaatatattcagcttttggttcatcaagctatctcattggtggtttaaaaaacccgtatatcttgtaatgcctctaaatcctttatgagttcttccttggattaatttatggttttgaggaagctaggtatcacaggtcaccctaggaaaaataacaatatcaaggaatagttgctttgctcatgggtttggttaatctcccctcatggttttgtatttggtttgttctttcaattatatatatttattggtgtgcagcgcctagtcattagtgttggtggtgccaacataattgggatcatgtccaccatgtgctagcttgtgtctgcccctttttatttaagtaaaaaggatcactcaaaaaatcttactcatatcaaatgactgtctctcaattctcacaaaatgtggtcgtcaagctcttcttcatgtcttcttgttgctcttcaagttggaagtaccttgttctccaaggtttgatacatgggatcagaagcctctcgcttggcttttaagtttgtctaatgagcttgcactaagggttaggacaaaaatagaacacaagtaatatgatgcatggatatgttcagtcttatgagacggatcaccataaacttcatcaagagtagataattggtgcaccaaatggtctaattcatatgtacttagccttgataatgataaatgaagggtaccttcaatatttgaaagcttagcttaaggagaacggacaaatacaatgcaagaagaattttaggatacaaactttaaaaaatttccaaa

SEQ ID NO: 6858 - DNA, 1000 bp, Glycine max
  Soy_ogl_6072 Gm18:191401..19351800 Cluster 31
tgaattcataacccagttaccaacaaataacatctttatgcctattttacatatgtttacaccgacacctgggagacttgtttagaaaatggcaaccacagccagtgacacacctttaatttgttggaaaacatcattgcttataataaaaatgatacacacacttattgtggtcttggttttatagtcgaatgtattggaattgatcttgtcgcctcacaaatataactttagtaagaatacatgtgtttggttattgttaatttgattttatctctgaatctttaagttaaaaattttgcattcataagtcttattaaattttctttcagagtaaaaatatttaaatataaatcactccatttcaatatcaattttaatcaaaatcattttaaaaaaattaatttaattcaaaatcaatttcacaattgcttacataatcacacacttaacctatgcatataatttgcaacttttaccaaaggcgctttatgttcctttcggctattcagagtttagaaaacagccacttctgtttgaacaatgattactcctcatttctgttatttgaattagaaagcttagaaaaacgcggcgttcatagttgtaaattatactattacggaagaaatcattcagacattgttatgtgggctaaagaaaaacgtcgtggtccaaagctatgatgcatttatatggctatttagcttaggaaatgatgtcatactagtgctagatacaaagtctaagggtatccaaaagaacagacttctaccttttccttattcatcttttttttttttttttatatatacttttttcattactcatctaacatactaacacatgctaccgaaaatatactgtacaagacagagcaattagtgtatcattttgccactaaccatatacgttaatgtgtcacatcagaaataaacatcatatttgaatacttgattaatgaatcttgaattccctaagtccgagtttggtcatggca

SEQ ID NO: 6859 - DNA, 1072 bp, Glycine max
  Soy_ogl_4563 Gm13:38977701..38978772 Cluster 32
aaatttctattgaaatgattttttctcatagttttatagttttcaatgaattttaattaatattaaaaagcttgaatatatttttaattcctcaaatttaggggtctatcttaacaaataatttttttagtctcttgctaaatttttgaagttaacataaaattatatatcatttcacaaatttgagggaatgacataaacaatcttccagactacatgatactatgcttcccagccttctttaacactgttaatgtgatgacttatgacatctttaaagaacgggacatcaaatgtcttcctcacctcacaactaattattcctttcatgtagttattgttacttaaactaattaaaatgttcacttgattaatattacttcacagtcgtctgatttgtgcaagtcatgcctccaagaagcaaaatggttttacaacaaagtcatccaccattcattgaattcctagaaaatggatggatctcatcctcaggaggggttcttcttactcattcccacatcttagtcagccaataccaaaacatcacagatctagcatgaccctttgcgctcttcactcaccatttttttaggcttatcaatgatttgggaacatcaacggtaatctcaacttatttgtttgccacaaccccattaagtaaccccgccagatgaaacttcatgtctaacactgtgcttgttgttctccacaggatgagatagagaggggtgaaacctcaaattcaatcgttagctacttgcatgaaactagtctttcagaagaacatacccatcaatactatagagctttgattgacagaatggcagaacttgaataaatacctagttatgaactccacattccccaaatctttcatacaagttgtctttaacatggattgctgagtgcacatccaatatggagatggatctacacgacacgacaatagatcaaagaacataatagagttgttactgtttgatttattgtcgtgtgtgtatgtgacatgatgacgttaagaaagtgctctgagtttaagttgatatccaacgcaccttaattaatacaacag

SEQ ID NO: 6860 - DNA, 1046 bp, Glycine max
  Soy_ogl_3450 Gm10:39038555..39039600 Cluster 32
gttaacaatgattgaaaatgtgaagagaagcaagtgagcaactatatatataaaattcccaatgcaaattcaaagcaggcggtcaaatgaagctaacaatggttttgttttgtttttgcttgcacttctacaagactacaacaccacacaataacactttcttttttattaaacctaacaatggttttgttttgtttttgcttgtttgacaatttcacctttgcttgcacttctacaagactacaacaccacacaataacactttcttttttattaaacctaacaatggttttgttttgtttttgcttgtttgacaatttcacctttgcttgcacttctacaagactacaacaccacacaataacactttcttttttattaaacctaacaatggttttttcaaaagctaatactagttgaccagtcaaattgctcgtcaacttgaaaattcaaagggtttgattttgcttcggtatttgataacactttcttttttataatacatcgtagtcttaatcccgcgtgctcaaatatagagtaagttttattataatgcatttcacgcattttctttattcatacattattctctgaaattagcaacaataaaaaaaaaaacttcccatatatgtcaacgcagtctaatgccacaaattttcaaatttaaaagcttaccatataatttattcatattaaataattatattcaataaaaatcaaagcaagtttctttattctatcttatgtcacagttttaaaaggattttaataatttcaaatttgataaattagtttttcttaggatatgcaatagttattttacaagttgtacactaatgaattattcatgtataactaccttttgttaaaatcttactgacactcttatcggaaagctcagaattttattcaaaccaacatcttattgatattataaaattctatatttttttattgttttactttttatgaaaaatcaagattaacaattattatgataatatttttattgtaatattttttgtgtaataaattaaattcaaaaa

SEQ ID NO: 6861 - DNA, 1102 bp, Glycine max
  Soy_ogl_2237 Gm07:6691499..6692600 Cluster 32
catataaaaaaatcagttgtaattgtctacttgatttcaagataaatatattttattaatgagaaaaatagacacatcgatgaactatttcactttcatacgatatttttcaatttatacttttaaaatttaacttaattttgtataaaaagaaattaataaaatgataaatttttaaaaatactttaaaagttgatgaaaatacactaaaactataaaaaattgttatctaattaaaaataatcatatccagtaattttttagttgagtttttataataaatgtcaaatagtgatattgtgaataatttctaactggttgttggtaaaaaaaataaaaattaacctgccaaatgaaaattaaagtaccgttttatcataaaatagatacaatacagttttcataactacaaaatatttaatagaactaaattaataataagaaatagaagctataaagatatttttattcatctaatttaagacttttaagtaatagatgatattttacatatctggtagaagaagattaaaaatattttacttgattgggtgcccaatgccaaagcctatataaaggaaactgggtgatgaaagaaagaagaaaagttgaattggaagtgttagaagagaataatgtcaggagggaacaacaggagcgagcttcctccatcggatcaagggaagaagactctcactcggcgtgggagatggagtcaagaacacatgtactgttttctttcttaacattgttctttgattctttttctctcaatcattaaaatatttatgccatttctcttgggacttagatatatccaaggggagattggataaacattacaacaaaggttgataagcattcatgacattaccttacaagacccatccctttccagacaaccaccagaatcaggtttcctattcaaatcttccaatgcatctctcagcccctgaccacttcaatcatcagaatcagtttttttcttccaattttgccatgcagccgttccatggaattctttattcagtccctcagcacatcaatcagcagaatcaggttgcttcttcaaatcttgcaattcaagagttacttggaatgc

SEQ ID NO: 6862 - DNA, 1000 bp, Glycine max
  Soy_ogl_27 Gm15:16792101..16793100 Cluster 32
ccaaatttttggcatgggcaatgtttctttgtcttaaatttgttctctaccaaaaattggatagagatgagagagatgacgtaacacgaagaggatgagagtggccaagcttgttctactcgtgatgctcaattgttcatgatggcccacgtagagttatctttccccagcatgcatgattgcatgaacacatcaacagaaacaaatttgttatgttaggagaagcctcactttccttcgtactactgtgacacttataactgttcctttgttccatttatttaaagggtgattcatcatcttaggcatggtactatttttattttgaagggaagttaaaatgagttggatttcaaagatttgttaaaattaggacatctctcattacttaaaagaatacttataaatgtatttatagattatctattaacaataatttttatattggcagcaattcaattcatattcttaagagatatgaatttatttcttattagttatttcaactttctctgttttgtagctaagtgaaccaaacggacgcagatcttctgtcccataaaatatttagagaaacactttcaaaggaaggagtttggcctatcatctaattcatgctcgtcatttccacacgtagcttgtatatatcacaattatattaatatatgtatttgttaaaaaaagattaaataacattgtttaggagtgattctgtcacttgccattgaatttaattaattaaaacttaagaaagaaattgagattgagtcttcagatttatgtttatagaaagtgtaaaattatttagtattaaatttaaattcgacatgtttcaactagcagaatatatacttacattttgtcccaaaataattgatataatttattttatttcttctgtttaccactccaaattatttagacaaaatagaatttacaataaataatttactttgaatttataaaatttaccaaaataatagttgaatttttttattca

SEQ ID NO: 6863 - DNA, 1237 bp, Glycine max
  Soy_ogl_6078 Gm18:22169742..22170978 Cluster 32
taaaattaattttgtatctttgattttaaaaatatttttgaagatggctcccagactaataacaacacctaattaagaccccatccaacaaaagtcgtgtatcacaaaatcatggtggtaattgcatcccttattgaggcaacactttccatgggtacaaatattaccaactccattgactagtcatcaatgtggagtgtagcaagaaaatgacgtgccaatgtgattacaatgtcataccaccattttcttcgttagtgtttaatttccctcaagtgcttgaaatctagagaaattacatggtttactaagaaaaccttcatgccttagcttcaaaacaacatcgattggggcacaaatagtcctaacgacatcgagcttcaataatattaggctttagctcctattatggtgttgattgtaacatccttgatttttgacttttcgacggctctcacaccatgacacttcatgtagtggcacttcaatcaacatccttgttggtcagaaccctctctaggtaaccattttagagaccgcgaaaatcaactctgcctacttccaggataaatgagtgatcccttaaaccaacgtgagacttttcagtgtgctttgtcctcactcacatgttttctgggaaacttcccagaagaaatcccatctcataactactttgagccaaacacacttaactatggagttcttatgtgatgggctaccgaaaagttgatgcatcttattagtatagataataccaattaattcctttaagacatcctcagctgtatagtcccatacatgcacaacctctggatccctttcattctagtgtgatttgatcagggtgttacattgatcacgaacatagtgatcccaaagacaatgagctttaatattattatgccttaattccaacatggtgttgaccactggcatagtggtcccaaagataccgagctttaatattattatgcctcaggtccaacatgttgtcaaccaccaacatagtggtcccaaagacacaaagctttaataatttcacatttgatatacacatataaaagtatcataatgagatctatttcatcatttattcatcaaatcaaatgtaaaatgtcatcaatacattattcccaaaattcaaaataaggatccaaaaaaatgaaagaagaaataacataaatctaaagcgcccactaaccaagcatatcaaaagaactcacaatgcccacatcat

SEQ ID NO: 6864 - DNA, 1197 bp, Glycine max
  Soy_ogl_3168 Gm09:38283504..38284700 Cluster 32
cttaatccaatgcactcccttaaaagttaaaatagtaatgacatgtattaaaatagttaacaaaaatactgcaaaaataatttagaaaaaagagaagatatataaaagtgtattaaaatagaaatcataaaaatagaacaaaaaataagttacaaatttgtaagttattataaactagctagagaacctagctacttaataaaatgcaaggcttggttttgaaaatttgagtctaaattaaatgcaggttttttttttgcctggtccgatctcgatcatgttcgggcttaggtcacaaaaactgctaaaagcctcagaatttgagcttttgtagggttcgagttacattttaaaggcctgaattaaatataggtttttttttttttttatctattatgttatagccttcggctcgcatcgggttggataaccttattttgctacctctatttatttcacatagatcagtataatgatgtgttttaacataatatggagataatatacttcacaaattgaaaaacaaacgagagaagtggctcgtgttaaaaaaggaatcacaattgttcatcaacctctctttgagtcacttgaccacaaaaatgataccacaattacatgtactacgaccaatcgtggaattatgcttcacaaaaagttaacgaaatgttcaaacgaaattttgacattctagaagcatattctagataaacaagaagcatattctagttgcctacaaaaaaagaaaacataaataatgtagataaacaagaaaaaccattacaaacaagaataatattttttattcagcaaaattaagagtggggaaatgaaactaaaaaaaactgattatacttatgatatcatatcaaatgttaaatcaatcacacggataaagaaaaactagtaaaaaaagttggtctagactatggtgggtaggtaattcaacaacattttacttacaagtactgaatcattaggatgtgcccatcaatggaaaataacaaaggagtttaatttgaatatgtttgaattggattagatattccacacttgaaaaataaaatttgattaaaaaattagtttttttttcttctctaaaaaaaaagaaaaataaactcgctctataaccgatactgtgatatggtagtcatggatgcaagatgggaattgtctgtttttgtcatatacacaaaa

SEQ ID NO: 6865 - DNA, 1200 bp, Glycine max
  Soy_ogl_3368 Gm10:4750401..4751600 Cluster 32
tagaaaaatgttatagtaaaattttttatgtaagcaatcacaattaattatttataataaatttactgaattttaaagtaattcaaatgaaaatttatgattggatgtggtcagtgcataatgattaaactctattaatattattattttaaaatttgattttgaaagaataaattgtaagattataatataatactacttcagatagtcaagttttttttcactaaagagaattcattcccctacatttttcccttacccccctcccataaatcgtgaaaagaaaccctaaggcctcaagttatctgtttttttcttcctcctcctttattataattttcattttactttctgaattagtacgtaggactttcatccttcttctctctgggaatcatatagaaatgcacttcttccctttaagcttgataaatgttatttttattggtaattttcttttcacgatactttttagacaataaaattatactataatttttttttgcgagtatttacccccaaattttaatggaagtgagagtgggtacgagtactatcctatttatccggcctgctagctcttattatatttatagatttaattaaaatattttacatatgtaaacaattttacactactttaccattaaattctttcacataaatagtcacgaaaatataagtgaaacaatcttgagtcataactacgtttttattccttacattcatacgtagaaaaagagtagcatcacaacaccgaattgaatgtagggtctgagaaatgaaaacacacatgatatacacaaagagccaagtcttatatcaactagttcaacacgttctcttagttgttcactgtcatataccttaattgccaaggcaatagctagtcagagagctagctagcatgtttgtgatgatgccttggtgattttttttactttcctcttttcggccatggttggtgggtggaggatttcgaacaaccgaaaaacacacttgttgctaaaatcttttatgtgctatcaagtcttacatacattacgaatgtacttcgatgttgaaatgtcgagcaaaaacttgagggggaatttttaacatttaatatataaatgagcttgattgcctaaatttttttaatagagtaatgctataaacacatttttctaacatgttctttagtatttgttgaaatttatt

SEQ ID NO: 6866 - DNA, 1434 bp, Glycine max
  Soy_ogl_1002 Gm03:40646201..40647634 Cluster 32
cgcgtgattgatttagcctgtttataggtcctaactcctaaggctcagtgtttggagaatcatatcatatcctcactcctaagcaatcggcagatagggatggataaaagcagaaggtaatttgagacttgatatctctttattttgaagtgaattttaatagtatatgttcaaacggatgttggtcagtgtcaggtttgtagtacatgcccattgcaacgttaatcacgagaggcaattagaatgttcctacatcacaccattaaaaaaaaaatcagtttatggtttgattattatttttttacaatgtcagtctatggtttgattgacttttagtttttttgtggttttgaattttgataatttaaagcagtatgatttgattttgaacaccccaaactccatctcacgtttgcaagttgccaccaagttaagtcagtgtagctaaactctacaatctgcgatacagggaagcttttaccttcaatgtcattatgtcaagtgccacaatggagcttcgttgctggtgacttgttgtacattaatatgttgtcacctccaacctgagatatcccttattccttgcatcttgcagacatgcacaatggttgcatttctaacaactaacaaaaaaacaaaacaatgggtgtatttccttcactttttgttttctttgaaagacacatttccttcacttgtaaaatctcatttttacttttctttgcaactacattaacaaataacgttggcatgttccattgtttatctgattttggatgattgtgtactgttgggtcatggtgcgaaagtagcgtcaagagagagtaaaaaatacctccgcgaaattggatctgaaaaaaaattattgatgaaagaaatttccttggtcaatagtaaatatttcattatacttaatattgatgaaagaaatttaaatattgattttaaaataatgaaagtaataattttatctgaatgattaatgatttaaatattgattttatttggtataaaagaaagtaaaaacctatttgactatcccatatatcacaaaatgaaaaaaaacataattacataaaaatgaataagtatatgatatattattttatcgccaacaatgaactcaaatcagtagataactttctgttggatagtaatgttgtctttcattattattttaaaataatgaaagtaataattttatctgaatgattaatgatttaaatattgattttatttggtataaaagaaagtaaaaacctatttgactatcccatatatcacaaaatgaaaaaaaacataattacataaaaatgaataagtatatgatatattattttatcgccaacaatgaactcaaatcagtagataactttctgttggatagtaatgttgtcttcgtagaaaaatgtattttaaagtgtatctatttgc

SEQ ID NO: 6867 - DNA, 1016 bp, Glycine max
  Soy_ogl_2202 Gm07:5018953..5019968 Cluster 32
gtagttatcaatgtcacaaccaattgttgggggttgtagtagaagaatattctaaaactactagttatgtgattaaattgccagtggattttctggttttggagttgttactccatgtgaacagctttgaaaatagtaatattagaaaggtttttgttccctacacctccaacaaacctaaaagaacccaaatatcctgtctctcccaactaagcttggcctccattcaacactgcactctactacccttatgtagaaaaacagtgccaatggagtcgagaatgaaagaaagctgtaaaacttggctctattccaggcctccaaactagattaattttgtttatacttatggaatgacttttttggaacatatacctatcttagaaatgttttttttccttcataaatacatttccaaaataggtatgtgctatccaaaagacatcttcagaagagaaaaggaggttacaaggggtgtacccctttaaggaaaaagaaatgagtaattaaaatatacaaaggggaatggggtgtacttataaacaatgggggatgtaaatagtaagtgcaaaaaatattactccattgacatggttaactgctagtattactgtataaattgatctatttgtaatataaaaacagaaacataatttgtgggattgacgtttcagttacgtgatcgatttacattttggcacatcaacattttatcattgatatcacgtcttggtttaatccttcattttcctttttcaagagtctagtcacatctccttctaattttttttcttcttaatctgttgtttgttatatttattacattatagtacttcaaatatttaatttttgttgttgttattatggtacttcaattattcaattgaatgaatgttgcttattttatcccttcattggctatatgtattccaaattacaaagacaaaagatagagtaacaaagagtatgtctgttcgtcatgtgttgattcagtagatggaggcaaaccagtgaca

SEQ ID NO: 6868 - DNA, 1200 bp, Glycine max
  Soy_ogl_3928 Gm11:36801001..36802200 Cluster 32
tgataatatttaatctaatttatgggcattactttggtggattagtattttaaaaatagtttaaaatggacagtaatcttaaattattaaattaatttcatttgatagatcaaattttcattttctacattagataatagcttctacaaatcttttcctaacttcctaacaaccactgtagtcaacaccgtaggccggccgccaccgggaatcgacggcatttcataaacttcaatctagcttccaccaatatctttttctacttcatgtggtttcatcattttttttttctcatttttcctttcacaatcagttttttctctacctccagatgaacttttattttgaagccataacgaaaagtgaatcttataggttgtagggtaaggaattggaagagaaagaggaatgttataatggagagggtctatggtaaaatatacaccacggatcaatcggacggtttataactgtgatttaaaatggaccacttttataggtggaacactctacaattggccctaatttatgctgtttaattatttaaatttaagtagaacttgataaataaagtgaaaatcaagaaagcttaagcacggatattgttttgaattgtcgttattttatacaatcatcaaattacacaatttcttacctctggccggtatacattttgttttcctgccaagccttggcaaatggcaattcagtgatacccgcctaatgcaatgccctcgtttgacagttttcacaactagtgcagctatgtgtttgttttaaattattatctataaataaaggtaagttgattttttttaacaatatttaatctagttaattaaggtttactaaatctgtaaagtgtatgtggaaggatccttatatttgtcatactttgaggtaatcttgatgaacgtgagaagaggtgtgataatgagatatattaaaatctcccatcaaataaaaatagcaccgaaatatgaaagatagttcaacaacacttatacttgagtttaaacgtgttcatccttgattttttgggcatggcctatttaattattgggtctcaatgtgggtcagtttccatttggttagttaaacgtgtctatgagataaacccataccatccttgatgacctgagaaaggaactaaaaatcgcatacttgaagaattcatgatcagatgccatcgctttggat

SEQ ID NO: 6869 - DNA, 1051 bp, Glycine max
  Soy_ogl_3364 Gm10:4343101..4344151 Cluster 32
gcaactggcaattataattgcccccgttagagtgaaattggtcaggactgctccagaacctgagatttgtcctcactgttctcttgatagaatggatcaagctcctaagaaagtggcaagtattaacgtctaggattccagctcacgtacttgtcaagaatactcaacttggagtgaagaaaatgaagacaagacacaatttttcttaaaagatcatcacaataaaaattagttgttgccatgtggatgaatgtaaaatcatgtaattatcttttcccttgtttatatgagattcaaaatttcaagagcaaagaaaactatcattatttttatatggttttcatttctccactttaagatcacaccacaaccacatacataatcttagaaacgtaagcagctaaattaagccgaggggataagcttaatccatagactgtttgcatttggagagataccaggtaatattgtaaaatttatactgaattatttataaacaaaataaatgtgacacattcacctttatgggtaactcatgccacggccaagagcaaggcaaaaaatatattcccaactcctaataaaataaataacaaaaacgaatggaagtatgcaaaagttaacaacaatggtagtcgtagagcagcttttgttataattcatagttgtcaccgttttgttcagattctttgaattttttttgttttaagataaagattctttgaagttaaaaatgatgttgggcttttgaaggtggaacaataagatatgacggtatgacggtatgactatatgaggtaaaggacaattgctttctgcacctctatggtttttttctgcacctttttcagcttctaaaaaaactattatggaatgtaaaattatattccagattagtctctctgaaatgtaaaaaatttacatcaaagaaagtctaatctgaaatataattttacaagattaggtgcaagaagacaagataaaggtgcataaagcaattgtcaaggcaaaacattggtcttattggaggaacctgattatccggttcacg

SEQ ID NO: 6870 - DNA, 1174 bp, Glycine max
  Soy_ogl_5596 Gm17:8990101..8991274 Cluster 32
tcctaattaactgtatatctgctgtatgccccacactttcactacgcactccctctctgtctctcatgagccataataatcacacgacacttcaggaaaaatctatgcaacttttttattcaacattattcgggaatattcttgtctagattgagtttatagatttaggttttatttaactagtagaattgaatatgaaagttagttttagaagacatttttactttaaaaaatattttcaaaatcattttctttagaaaaaaagctcattgtaaagacactagaaaacataacaatgaggggtttaaagaaaaaaagaaggttgaattgtatttttttcaaaaattaaaatctttttgaaacaggttgaaagcatgtagacaaaatgtttcactaatctgtataaaactataagaagaaatagctatatatattgtcctatgggtgatcaacaactttttataaaactttaagttcaaaaatgaaaacacttcctcacaagctctactctcttaaaatcattaataaaataaaaaggggtgaaggaaaaagaaaataaaaatacaaagtttttgttttggtttgtttcactcctcggggtatgtatatagtccttgatagctactaaaaatttcactaataacacataattacaggaactatattctaacttatatataagtattgtttcatcctttagataatttctcaagtattctttcacttgtatctttaggtactaaaatcaagtgttgttcaatcaaactttataggtttgataaacaagataaccctttactataattggttaagctcaggcacaaccaatgctggagtaatgcatttagtgtattcacaacttttatagagaatggttttataatggttgaaaataaaccaacaaaatagattcgattttgtcagtctttataccatgttgaaacttgatgcttttttaagcgattttgaagctaatcgttggggaagtttcctcgccttatcggaaaggaccattcattgaagtgcattgttcagataaatttatttgtaaatacttatcggaaaagaaaataaaaaaaataaacgaaaatctctaaaagataaataagttaatttaatttgtactattcctatatatactaagttacctcattcatcaaaactaaacaaagtg

SEQ ID NO: 6871 - DNA, 1200 bp, Glycine max
  Soy_ogl_5284 Gm16:4174901..4176100 Cluster 32
tctattacaatttctaatacattcatcatacaatatattgctgaatgtgaatgatacaatctttaattcctttttttcttctatgatcaacattgctagcgtctgaggagtcaaagttgttgctactagtatttttattcccccttattactctatgtacctcgtttaatttgcacttttgtcactgggattcttctcattgttgacactagccttttgtttttccttcctcttggctgccaaaatcacattttcttccttaccatttctatttgtcttaatattaatgatgctttgatttccaaacccaatacttttcttttcccccacccctcaatagttttcaacccaacctcatttttccaccatattcccctatttgttatgatggtccatttttgttgtcccccaccctggacatatagccaattaactcattccctttttaaagcattttgccatcctaaactgttgtctcattatactccttctgtttgttcacattttggatctcctcgcttccctaggccattttgtttattgattgcccgtccctcacatttgatttttcatcatacaccttcattccctccttatagatttttccatgtgttaccctacctacctcctcattagcctcgtctcactcttgatgtgcaatttgtattcttaactctacacattacatcctctttactagtcataccattagaatcttttgagttctttccaccaacatctctttttgtgtatttgcaacacgtctctttcacaatttgaaccttgtccaatgtcctttttctcttcattatggatttccctaacacttcccatcatacaatctcttgccccacttttttgatccctcaagatatggcttttgtgaaggatcgttggtccttggataatagtttcctcttgtattgcacgttggatatttgattttctttctctgtgattgtcattgccctaaaccacctcagccattgccacatccacttctctgttgaactctgagaatatagattgcacatgcatacccatatcatttgctattgacgaaattcgtgtattcggcttcctgaacttccattcgttgcatctgcacatgatattgtgacaccaatttcttctaccatcttcaccttgtataacacaccatcattcattacatctacaccttgtgcaaaatacatgtgc

SEQ ID NO: 6872 - DNA, 1023 bp, Glycine max
  Soy_ogl_4002 Gm12:4905501..4906523 Cluster 32
tgtcatatatcatatatgtgcgtcctaagctctactttcatctttgccatcaacgctcgtcctctaagctaagcacaacatatatccaccaattgaaaacaatttgttcaccttgaaatgaaatcattcattacttccttgaaaagtgaaaacttatgtgccaccttttttctctaaatataataggcattataattataatataataataagaggaaaatagaaattaagaaagatgaatgttagtgtagtgtttatagcaacaaaaaaaaaagtgtctatattcactaatccttcacaaaacagcccaaaacataagtggatccgtgtaaattgttctccaataatgcaaaataagtcgcactaaagatccttaagttacacacttttaacaatgtcacatccatatttgctttgctcaaatatagccacgtttttatgcaaattggtgtcctatgaattgcgtcgtcatcaaaatactgtgattactgtctaaaaagtccaactagctcatccatttgctttaatttgtttcgttcttacatgtggtataatatttttcttcagagaatggtttccccttgtccccatgtagacttaaatgatcaaattgtcaaaccattggagagtgacccaattgaaaaactataaatgccggtagctgcattttgacaaaattaagtggagagacgtagagataatagtctattactaaccacctcgtacatacaaatacaattttctcccacaccaaccacaccacatgcctcccttctaacgagtcattttacgatatgaaaaattgaaaattatgccaccgtgcttatttatataagaacatatttcatcacttgtgatatttgtttcccatatacaccatgaacatgttttaaaatgtgacaggataataatattttgttcaagttaaaaatgagaaaatatcaaaaccaatgttgaaacttttctggttaatttgaagatttaatttataagttaatgataatcataaaagaagtaatacac

SEQ ID NO: 6873 - DNA, 1200 bp, Glycine max
  Soy_ogl_1354 Gm04:42881001..42882200 Cluster 32
gctaacttggcctgtttcaaattatctgattcaaagcataaacaatatcttataaaaaaaatagtatcacccccctccccattgcatactggagcttagagatatttaaagaaaagactctgatgaatgaaggccaaagcagcaggtatttgagatgagcaacctctattttcttttcaatttggaaaattgcattgtttgcatggatgcaaagttgaggttaataggagtttcagaatttactctgcgtttagggaagatgaaagaaggttaatggctaaagaatactatgaagaaaacatagatatgcttttcaattcaaaaaattaggcttcatcatcacataattcatgagaaagtgcagtagaaagacattaacttggattctgcctcttctgtttcatcaccattttgttctaagaatcattgatgtctaaatacgataatatagtttcatgagtttagaatttcaatagtgattataaatattaatagttatagataataactacctgaaatttagacatgttaatgaattagagtaactcggttaatttgaataatagtagtacgtattatttttatcctcttactaaaatttctaaattctctacatctaaagatcataaccacaccattctaaacatgtaatagcaatgtattaaaacaccatatagaatctagcatcaccagtcacaatcaaaattttgcattctttgcagcttcgtaactcttgaaagcaatttaaattagtagtatatgttaagcacaatttacatttttgtgctttccattcaagctcattagcagtatgtttatgcgacaacttgaactcttgaaaacggaatgtctgggttatgctccacccgagacagattattagaaattcaaggtgggtaagttttatgaatgttgccaaaggacaatatcgatcttaattagaatctcagtttattgggcatcacattgcaaattcagatttccaaaaggctcaaattggatagaaccttgaattatattatgaaaattcggattaatgtggcattcttgctgaaacttgaaaacatctcaaaggtatattatataagaagtaatttgaaatcagagacccaatgagtgaccttgctatgccgaaagagaaaagatgaattttgcgaacaaagaaagaagcaatcgtaccggtattaagtagtaatttga

SEQ ID NO: 6874 - DNA, 1000 bp, Glycine max
  Soy_ogl_4790 Gm14:46660201..46661200 Cluster 32
ttttgaatgcaatcaaacatcaaatgcatagacaagtcatcagtcactaggtgagaatcaattcttctaaagctaaaataggatcgactaacatggaattaagatgaacaaggaggtaccttagactctacctgaataggttcatctaatccagctttgataacatctgtaattttagttaatgatttcttgttttagaacacaagcaatccaactttgatagcttttccattcttctttacttaggcaaccaaatgtttgtgttcttagatatgtataaacctaatttaaatattgaaattaaaattaataaagaggagaacctgtaagaggcataaagctggggaacctttgaattggagggagctttgtattcctggagcttcgttttctatttgcaaaatttccaacaatcaaaattttattccccttccatattaaacaaggaaaaaaatgactttcctagttatccatattcctggacttcgggaagaaaagaaatctgatctgcacaaacataataataaaagacatagataaatagcaaaaaaatttatgaacaggtagcaaatgaacaagaacagtttttccttgctatgtcttgtgctacattgtcctacaaaaacaaaaattttagaaccttcccataacaaattaaaatcgatcctctcttaagataataaacacttatcctaaaaattctaaacataccaaaatcaccaaaggaattgaacataggttatatataaaacagcaacaagaaaaggctacaacagttgaacttaacaatatgccaatcaccatgcatgtaacaaatctcggtcaagtataggggacaaattgccattagaattaatattctgattatgattgatatctttcgctacttcctcatggattgcaacttccttctccggaatagaaacaaacgagttgtcattggaagcttcctaaggagtttttggctgtttctcagcaactggttatattttgtagttgt

SEQ ID NO: 6875 - DNA, 1011 bp, Glycine max
  Soy_ogl_950 Gm03:38873190..38874200 Cluster 32
ctactataaacattatatacatctactctaaatgatatatatgatgtattatagtactaacagaaatgttttcttttttggtacgacgcatcatattattagcatagactaaagtgtctgtactaataatttgattttggttggacaaaaatcacactaacaaaggccaattcagtgctaattaacagccagtatgtgacgttttgcttttacaataataatacaatgcctgcataatgtgctacgttttcttttcttttgttacagccataggtgtgaaaccagaggtagcattttcgtatattccagaatctgtctcctgaatcaattccagaagataaaagggaaaaaaagatgaaagaaaaacaacctttctcctttaaaccatcttttgcagatattagccttagtaccttcacgtgacataaaaactagagcaattttccattctttcacacttaagagtgttacattcggatgagtcatgcatggaatgcagtgtaaaaagaaacgttaagataaatggggtgtaaagggagagtgtttttttttttttttgtttattgataaatattaattattaattttgtcagttgttaatagaggaatcgaacatggggtttttttttctttttttttgttaaccattcaatttgttatggttcaaaacctgcaactaatttacaaaactagcaaacagaacagcacaacagcaagcatacaaaagccaataacagaaaagagaatcaaacaaagataaggataaaagatgaatactatcaattacgtgttggtttagtcacaaaggagctacaggaaggaagcgaaactgatctgttatggtgcaagagttacaaaaatctgtgtacaactcgaatcttgcttggtcttttcactgtgtcgagatagcggcatcaaggatcccaagtcaagtttcactctatctctctcatacaccccgatctttctctttctctcatcattgtgattacatgaataggacctcattgc

SEQ ID NO: 6876 - DNA, 1240 bp, Glycine max
  Soy_ogl_5314 Gm16:5278661..5279900 Cluster 32
catttcttgaaaaattttaagttgtttacaaattgagagaaaaaggaaaaaatgagaaataaataattaatttgattgataatgaaatgtgataagatgaaatataaagagaaaatgaaattgttgattgagtgtttgaaatttttggttgtcaaaaactataatcactcttaaatcaaaacgtgaaatacaaaggcttaaaacccatgatagtctatgggatgtaacaaagttgaatacaattcttccttatgggggtgtgtgatcatataaaagctatgattcctcccaaactagcaagaccgaaatatgaggtggtgtggaaaggcgatgtaaatggtaaattctctctagcataagcttaacacaatgtcacggggctcaataatgactaggatcctttgtataatgtcatctggaagtggaggagaccagaaagaatccaaattcatatgtggaaaatggccaagggggctttgtttactaatgtgcaaaggttcaagaggaagctctgtgatgataataattgcacccagtgcaataatagcagtgaaagtattagccatgtttgtagagagtgcaaggtggcatgagcaatttggaatgtcatttcgagcaattctttgtctggtcagctttttactacaaatatttgggagtggctgctggagaattttaatcctgggaaggatccccataaccattgggcactgacttttggcgtgaccttgtccatgctttggagaaatagaaatgaattcatatttgaaatcaagaggcaagatgtggggagtctgatattcgaaatttcgaattcagtcaaccaaattgttgcttgctgaggagcagagttgaaggttgcagggagtattcacaacaatgcaggtcaggagcttatagcttggaatcatccttcagtggaaagcaataaacaaaattgtgacgtgtagtagataaaaatggcatgacaacttgtgggggagtgttaagagaccatattgggatgatagtgttgggtttttctttcaatattggtgcatgttccattacctaagctgaaggttggacgattatcattggcatgcaagtagcatgggagaggggcttcaaggatttgttcattgaatccgactcaaccacaataatttctcttatcaatgatgggtgttcatctgatcatgcttttaatcatgtggtagaagctataaaggattttgctaggaaagacgacattacgaat

SEQ ID NO: 6877 - DNA, 1000 bp, Glycine max
  Soy_ogl_2443 Gm08:872901..873900 Cluster 32
agataaattttcacaagggtttatgattgcgatatgagtctattttttcagttttccatccaccccatttacatgcgtatttgtaacaagtgtttgcatttcatccgattgctttttcaactacacaaaatatgcaccttttactgttagagtctacaggtattctctataggatactcacacaaactgactagaatcattataaatgtcaaaactttggttaaagtgaaataatcatgcacaattcacatgatcagtgatacaaaatctgaacatttagttttataatttataattaaaataattaataaacagataggataaaaaattatacaaatcattagattatgactgaaccaattgctttttcaattgtagggaatcatgccctatatatgtagctagcaatgtagtaacgctagtggacagggcaacaggttggtagtatctctcatcagccgaatcttgaccctctatgggtccattccatccattcatgtatgacctatctgagtgcctcttcctactccttctgtgtaagtaaaaagatatcgatttcattggcgattctaggatattacataactgttgtacgattgtactgaatcaacaaaatattaacaacgcatatgtgtcaattttagacaatatataattcttatctatcaatcactgcaggttcatgtctaaccaccataaagcatgatctacgaagaatggaaacagagaaattcaaccaccaaagacaaacagacatgaaggacggggaaaaaggtatttacccttaatgaaaactcaccaggggtggggactatattatagatcagaaacataaaagagattccattatgtcatctgttgctttaattttatattattgccatatcctgtgccatttcaaatcaccaatcacaagcacataagaaaagaagtagaacttattccaccagcaattgaaaactattttgaacccgtcatcttgtcaaaaagtgtaatcgat

SEQ ID NO: 6878 - DNA, 1200 bp, Glycine max
  Soy_ogl_3957 Gm12:308201..309400 Cluster 32
tctcaatccacttttaaaaatgaatcaattccttccagcattttttttgtcggatgggagttgggggttaaaactaattgaccactttacaatccatataacattttatcgtaatatcttatatttttaaaaaatttgtttgatgtttttgtacttcgagaggccaaaaacaccataacataacacagaagaaaaattattctacaaagagtaaattgtaagatgtgtgaagtattatatatataacatttgatttatatatagcagtagtaatttatgttaagtttgtatataagagtataaccatgttgttagttaattgaattgaataagttatgtcacatttgtttcaaatgttgttagtgaacacttgacggtgaagattaaaaggatagagattaagaagagatgttttaaaatgaaaatttgttgtgattaacgtaattaaatagtatttttgaaaagacagggacagacatgcctttgttttttgctcccgagtttgcttccctgatccttagccaagaatttggtttttcaaggtccttgaattcggggctacataaaagtatttaaattccgtgttgtcccagccacgaagctgcttaacattatgggccacatttaatttcattgatggggacaacagcccactagctagtagttattacagcataaatacactgaccatatgttggaaatccaacaaagtagtatgtttttcccccctttaattttactagtgtaggagtattaatactccaccaaaaatggatcaaaatctaattcaaataaatgatattgataggttctggggaaagaaaggtagactctggaaccaattttatgaacaaaaatacaggactaagaaatttcgaatgatttataaaagaaccttggagaagcatataaataaataatgtatgtgaattagtcaatcctaatattgaatcacatagtaccggtaaaggggagcttttcacatattgatttcattcggtagtattcattatgaaatggtacatattaccggtggggttaaaagaatgtgggacctgtcaaaactgtgtttgtaattagtatcacccacctaaagttagagacatgaagagagagttactgcgaatattttggcgtgagttgaggaggagaaggaagaggagcaataattagtgtagtatatgggatgcatgggaggaa

SEQ ID NO: 6879 - DNA, 1417 bp, Glycine max
  Soy_ogl_3982 Gm12:2892901..2894317 Cluster 32
gttgtgagagatgtcgaggagcttgagggaagtgaggttctcgagtttgtccaattgtccgatctccggcggaaggtagccgaaaagaggaacaaacgagacattgatagcaacgactcgaagttcttggtcgcagtttacgcctgaaaagaaacagtgtgcagaaagcgacgtggaaaacttccagtcatggagtccttcagcttcagcagcgcatccatgtcagtgaacgaagagcacgttgccacgcgcagccatatgaagaaaacaaattaacaacttcttatcatgtctctctagtctctgatcttgcttcgcagtagtcgctattatacctttgctgcgtccttatatgttgacaccacacacctcatgcactctctatttatatatacacctttatattatagtagcaaattaaattgaatatcatatatgcatgtacatcacttgcaccatggtagcatgcaatactagctacacgaacttggagttagacttttgtgaaaacaaagatgcaatctcttcgtgaccagttaagtaggtttaagctttccatgagcctaaccttggaatgaaacaaaagtggttttaagtgattcaccaaattttaaaaggagaataaaagaaagtttctttacatggaagtcttcctagttactatgctttagtatatcattgggataattattgcccatggaaaagccaaagcatcaattctctgttttaatttgttctgtcaattaggatcaagcactagttattgcagaatcggattctatgtgtgacaataaaagggtattatgcattaataaaaattaaagcaaattattcatcgaagctagtggttctgtcccaatcatttctaagttaaatgcaaattaccattttgttcttgtgagaagagaatcatcgcaagccagtggttctgtcccaaacatttctaagttaaatgtaaattaccattttgttcttgtgagaagggaatcatcgcaagctagtggttcggtcccaaacatttctaaagttaaatgtaaattaccattttgttcttgtgagaagagaatcatcgcaagctagaggttcggtcccaaacatttctaaagttaaatgtaaattaccattttgttcttgtgagaagagaatcatcgcaagctagaggttctgtcccaaacatttctaagttaaatgtaaattaccattttgttcttgtgagaagagaatgaaacagacaatgacctgacgatatatagatacatagtagttaccaacttacccagtgggtgcctgtaacagattcttcttttttcatttttaaaaaggtaacatactaatataatcttctacatataattagattaagtcacgagtaatgtgaattatcagtatttaattaaattttaacaataaaattaat

SEQ ID NO: 6880 - DNA, 1155 bp, Glycine max
  Soy_ogl_6193 Gm18:55951305..55952459 Cluster 32
tcagcagggtctttgtcatagctcaaatttcccctccctcccctcaactaaacaagttgttatatagatactataaatattttttttaaaagtaattaacatcatattaaacacttttctatttagggaaaaaattgaattttcctctttccctatatttaatgttgtgcctgtgacaaggagaaaccatccgaaacatcaattccaaactccaaactccaaagttctttacaaggccaaaaataactatgtcattcttttggcttccagtggccccatctatcatctttcactgtgaaatacagttctttctttatgggcatgttaatgatgttaccttctaatatcagatatttattttatttaatatttgtatgtactttcatgaatctgattttcagtactaaagtttaaacagaagtactttcctttattttaaaaaaaaagactcaatagtacttttcccttccttcaagaagaaaaaaggaaaagagcaagtatgattacttggatcatggaacaactattgtgaaattggccaacaactatttatgctagctagttgcataggaaagaattgaagtacaatcccttttattcataggatctccaacaagttaagctgctgcttgttcatgaagttgagaacaaggtgggattaaaccataatatattcgggtcatgtattcatatgttgctaactacttgtgatatgaaaattatactttttttttgtgtgtgtgaaatttataaatggtgcaagtttagtggcactttttcttggggtggtggtcggagacggtggtgttggggtcttgagtaggggttattccgttgagatgatggggtgcttcttccattatgtaattggagcttattgaagagagaatatgagaagtgcaagggtaatttagcactatcagcaacgtgaaattttaaaaataatcatattgtgacttttagtggtcattattttaaaaagaataatagatatagacacaatctttgatcgttattattttaaaataatcgaaattcataatgctaacaacgttagcttaattagataaaaatggttaaagtgatgtgttttaaaaaaaattaagaattacattaaattttaaaaataatctgggactaaattgattattgagt

SEQ ID NO: 6881 - DNA, 1052 bp, Glycine max
  Soy_ogl_6776 Gm20:35897572..35898623 Cluster 32
taagcgtacttaatttgttttcaaagttcatgattgcagctccactaacaaatgagaccagatcagagtttcaaggcaaccaatacaaaacatatcgtcttaaccacatttggcgtagttgaacataccaattcttaatcggaaatttaagaaattgttacttctatactagctacccgagtattgtggaaagttgattataaaattatatttgtgacaaatgccaatgggacgacaatgacattcatattattcgtataggagaaacaaaatatttgttcaaattcaagttaaatggatgaaccacgtccacattcatgcatgtaagtcatcataggggagggatcatgaactagctaggtcatttttctttttgtattatgatcataagccaccagttttggtcgatgagcagcctgcatgtattttggtataaattttttattttcagacactttttgggtgtaaaacttttgtgaagccatatatacgtatattttcctggaaaagcttaattaatgctctatagcctctactactccggagaccagaagcacacgttaaagtttaattagtttgtttaaacattagcacaattttgaaccaatttcctacaaaaggtgtgaagccccctgtccccccaaaaaaataatctttagttatataaaatccaactatgctgatcatatatttgtcaaaagcatattttttttcttaaagttatcaaatttaaatattgtataaacattgagaaattaaacttcattctcaaaaacatgtgcacttaattaggggatgatcccccacccccacaaaaaaagaaagtcattttttggttacataatatccaattgtggtgatcatatatttgtcagagcttattttttcttaaaagttgtcaaatttaaatatcgggtaaacattgagaacttcattcttacaaataagtgcacttaatttaggggaaattggcaatgagaaatttacttcatatatgagatttatgctttcagggaattgggtaagaagagttaaaaaaaaaaacttggtaa

SEQ ID NO: 6882 - DNA, 1000 bp, Glycine max
  Soy_ogl_6885 Gm20:40314001..40315000 Cluster 32
gacaatattattgtatgtgggaggccttcaacatcgtgcaaggagattcaacctatcttgaacctcttcatatataatcaatgtctacgtaataggtaaagattttatatatgttgtgattatgatgaaatcattactaactcaaatgttgaaatattttttatgtatctaatcacttttcacgaaatatcccatactgatacaggtttacgcaaagcatagtttggtcaatattctccaaggtttaatttagatcaacaatccacttgaaacacgtcagttcatttcatcttagatacatcagctcaactcaccttagacatgtcaacttagtacatatttagtttgcaattgaaattattactcacacgttctagtgtaatccaatgaataaaagcaaaatgaaagtaaaaacaagtattaatctctaacatcaatacttaatctaaaaataaaaattctatcaacctcaacataaatagtaatttaggttgggttgggccttcttgctttggtaggaggaagcctcatggccacagttgcaaaatgactagtagttgctcacgagtcatgataataaaaacgtgtaatgatgtgagccttacttaagcatagattaaaaaagtgggtcatctttgttgaagcattccattcaaggatggtacaccaagtgggtcctcatgggatgttccagatatcaaagtcaacactttcttagaggcaaagcttgtattcctataacttttttgccctttcttgaacgcttccttttcggtgttgaagaataaagagacatactcatatgcttatgctttgccttcctaacaggatggataagaactccaactcgtctctgactatatatcttccatttttttaaaaataattaatacatcatcattacgtttacttttttttaatttccatctttgacaattgttgattaaatttaaattaattaaatttgggttttcctggaaagagggaacgtggagaatga

SEQ ID NO: 6883 - DNA, 1000 bp, Glycine max
  Soy_ogl_7017 Gm20:46459401..46460400 Cluster 32
tcttacttctgtttgtttcttaaattctgcttcaatatttgggcttcggttagcttcttcttttctccccatggctcgcttatcagccattgacaatcgtcatagtccctgtttcttgcatccaacttacaatcccaatttaattctggattttcaaccttttaaccaatgacaattatagttcatgaagtctcattcaaggaagcttaccttgaatgcaagaacaaaactttcttgttgcaaaacctaatggcacaaatccttggcttctctcttgatgaagaaacatcgggttcttgaattttgaattccgtatccaaagacattattacagtgtaataatatgacagatgctgataccacagtagatatctagaaagaccttcaagatttgttcaaacaacaaaatgaaccagaaaattagtcgaagaaagacctttttagctttatgcggctaaaatcagtcagtcgatatttctcacatctgcatgggaatttgggaagaattgaatgattttcagccttcatgcctcaatgaagtccaagaccaagaccaaaccatctaatggtacaaataattgtgaatgaagtctctgacatgcctcaatgtatttttgccattgtctcaactctcaagatcagtgtcaacaactcatttattagttgattgctaatatgttacatcttacaagccataaactcaactcctgatgctgatcattcatttgttggcatttccttcccaccttttcttcttcatttgctatttattgccattcttctatatccattttatataattcaacaacccaaaacagcacaacacatcaattgactagtctaagacctgacatagatcatgtaaccaatcttttagaatatccaccagacccataaaacccccaacttacctccagaactcagtgcaatactgccctaactaccctataacttaccatatttcctatgattatgttcactcacatacaagtcatttgtc

SEQ ID NO: 6884 - DNA, 1050 bp, Glycine max
  Soy_ogl_746 Gm02:49325151..49326200 Cluster 32
attgttttgttatgaggaataaattatcaattttttatataaaaagtaaaatattttttaaaatatcaaaactcaaaatatagcacagtattatatcattgattcattgtccagttttatttttgcttaatattaagatgctcacgacttgataatgcaacgcattatatttgtgtatgtgcgttggctatcaggctatgttttcttttgttaattttttatttatttcacatgcttacaaaattctaacattgcatcattcatttttccttttctttctttcttctatataatttcatttttactatctaaattctcaacatcaaacgactacatatcaattctaatgttttgttttcgaccaaagatgagaacatatcatatatagaaggtacaaggacactccaatccgtatacaatatatatagaaaccctaccaataataaagctctacttgaagcacttgcaacccttcaaaaagcatagacaaatattctatccaagaaaagcacatgcctataacccataacctactacgatcttacaagttacatccccttcaaacattccatggggtacattgaccactaacttcttgactctttcaccctgttggatagccatactcaagatctaaatttaattaatttcaagtacatgttcagtattaaggacaattattgttgaaaataatattattcccatgtagccataaagtccaaataatagcaacccaccatgtaatcttagttttcttcccatatagaggccaccaatatgttgaagaaaatgaaccttggtctctatgggcaatacaacaacttcagaccccctagccacctataacactctttccaaatgtgtgatgaaaacctgcaagagaacatatatatgagcagttgttttttcctccaataggtagaatgggcaattgacatcttgatttttgtaatatgcatgatgtttctcaagttctcttttgtttaaattgtatcctgtcaagtgtcatcctccatacataagctgaaatgtttgattagttgtgtatac

SEQ ID NO: 6885 - DNA, 1000 bp, Glycine max
  Soy_ogl_785 Gm03:1264801..1265800 Cluster 32
gtgttattatttagttgactttaacgttgcttcagtttgccacatgatgacgcgttactttatataattttttagtttggagtttgtactatgtgagtaaatgcacattttctttattttagtctctctaatatactttcttttttaattttaatctttagctcttcggccacctcaacaattatcataactgatctcaattttttggatccattgccggcccatagtactgcgtatcgaagtataaagcaattaatgttgttttgtctactcgcactggacaaataaaaatactgttttgaccattattttcttaaattgttaaataagaatttcctttcaactggaaaaacacgcctatttctggtccctcgttgctatcatttcattttcaagagaatcatctggtgctcataaggttaaacgtattggcacatcttacatctatctttttggctattatagtatttagtggcactggtattattaattacttcaacttatttggaatcatatgatcatagaaaattgtaccatagaaatgagaaagaaacttgatcatatgaactttcattgaatattgattaattgaataaaatataaacgtagacacatgtagtaccataagtgtttctagtattgacgatcttccattagaattttcacttaacttacgttcatattcaataccaacttaggtaaaactttaattttaattataattagtatatatgagggtcgtcgcaagagtcaaccattgcaaagattgaaaataaaaataaaaaaacaagggaatgagcaggaaaagctaaatctttgtggggacagaacatgagaccctagaaagctacaacacgaacagcagagaacccaacgcaattcttcaaattctaggtccaccaatattggaaccaaggctctcctcatccacaggtgggatcatgaaggctgaagctcttttaccatattaggagttagatgcttataaggaaacacatca

SEQ ID NO: 6886 - DNA, 1063 bp, Glycine max
  Soy_ogl_1085 Gm03:44403338..44404400 Cluster 32
gacattattaatatgaaacgtaatatttcattatttaattggatttaatcttaaatacaataatagtgtgagagttatgctaacctccaatcataaatttttatttgtgaaaaattattgaatttttaatatttattttaaaattcatgccacgataattttaagtggttgataattatatcaaaacataaatttttttaatatgttagactagattatttagaaaatttaccttaaattttagtttttaaaaaaatactgctctctttaacacctcttgtgtatatatgaaaaaataaacaagagaggaaaaacaatagccaagtcatttgtcactttgaagtgcatccaagggactgtaatgctgccggagagagctggagaggatccgcatccgaatttcatgcagaaccaaggccaataaagtaatgataataataacccctttattagcataattgtttttccctctttttttgtttctgctgtcagtgtcattttcaaattaataaagtcattacatgcatgccctatgtggagggggcccatcaggttaatgaaatagagacagggggaccaaagggcgtgcctatttttcaggggagctaggtaccatcacgcctaaatgtgtgtcattttagagaagctactcgttgcagattactccaaaatatattttatactaatgtttaatgatcatccaatatgataccaagaagaaaaaaagacctcaaggactcaaaagtacactctactggccaaacaaagaagaataaaacattagcaatatttccatagtatggattaatattttataccatatatatatatatatattttttttttgtatatgcttcagaaatctttataccatatatcatatatgaatgctttcctattcatttagagattaaaaaaacactgtttgattaattatttaattacctagaaaagcaagaaacaaaattattgaatcctgctagccagccagtagcaaggagcaaagtattaagtacctacacggcactatatatgtcagcatgcatcacgtggctcgctaaaa

SEQ ID NO: 6887 - DNA, 1300 bp, Glycine max
  Soy_ogl_2453 Gm08:1525901..1527200 Cluster 32
ggggtaataaaaaaatattataagaaatattagcaacggcatactttctcagataatgtgtttggcttaaggaaaaaaacggaaaggagtgttttttttttttttttatcattttaggccccttgattcagcatttactaacagacaaaaaatgtaaaatattatgatattggtgtaaatagtttagtttaacgcaaattaaattgttagttagatattatgagtttatatttataatgataacatgcattatggtgtacaaatgtattatgatgtaagacaattcataagagattgggttcgaattcgatggtataacaccttaaaaaaaatgtcaggcactcgagcagaaccttacccaccagcatcgtgaccatggaaatttagctggccgaaagaatcattaaaggctcaactagagcacatgtggacattttacaaattataaaatttaccccaaagtttgcaagttagcaattgaaatcatgtatatatatattttcactgtctaaacgaataaagaaatatggcacttggtattaagtcccccgccacctgggaatgcatcgtctcttacttgtcattgtgatcttttcacttatgattgactacttcaagatgtttgaccaacttccatggcccatgttttgtgctgcttctaattaaagtctctatagccagaatttcatgtgatggctcttcaaatatgaatgcatgcccttttgttacaattaactatttgataaattaattccgacgaattgaccaaagactattccaataggcttcaaggtaattattgggtatagaaaaatcgtaacgattacatcattgataattattagtaaactagctaccagttatttagacggtgaaagagcaattgaaacttttgtagtattattttataactcaaaggaaattcaaagtttggagctacagtttgaataccatattctgggtaacagggtaagtaatcttatccccgtcccttaagttcagtgcaaaagaccaagtcgtcgtatcctaaattcccagagccagcgaaaaattacccaaacagttcacatatatagcaccaaacccatcgatctcccttggtctatatttttttctataaaaaaatacaatatcctactagggtatagggaaaacttcatgatcatttaagtgatggttattgaagaatattctctctaggaggctgaagaggaaaagaaatattttcttaatttttaccaacactcttgcaaataaatgtcttgataaaatgagttagacacgggactgttttagttta

SEQ ID NO: 6888 - DNA, 1000 bp, Glycine max
  Soy_ogl_4153 Gm12:38614001..38615000 Cluster 32
attttgataaatatattaagaataaaaataaaaaatataaaaaattagaaattaatattttaaaaaaatgcaaaaaaaaaatatttaccaaactatttaacaagttttttcattaataaaaaaaattaaaaactaacttaaataacttcctaaacataacattttttggacacaaactaaaaattttacacccctaattagatacttaaaaaccacaataatctacccatcatctcatagcatatttgataattaatgagtgttgttgaagacaacttgaacagcaattagtaatttcatggtcaaaacccaaaaccaaagaaagggttgccccaaaaagtcattgagatgcagcacgaggcaaagaggaaagcaggcattattttattttgtgtggtgcaagtaatcaacaaaaaacagagaaataaaaggaagcaacaacagtgcgagtgcgagattaagctatcacgtgcacacgtgccattccagtgaatcggtgcatcgtttctcataaacaacaacgtagcgcacgaattgcggggttgctccacccatctccaccacgcgctcaaagtttacgcgccatagatggagccacgtggactttcctgcagggttccagaaacttgaattcgtttacacgggctgttaattacacgcgcctcctctgtctctctcctccgtattggacggctcaccctaatgctcaaatatgtttttttagggacttgaatacgttgttatgacccaaagagaatcaattcactgcatcaacgttttcaaggaaatttgatttgacacttataattagattcaacgcctcttaagcaaaaacttaaaataaaacaacaattttaatcattggttaaaaacagattatatatttttttttataattttaaatgttaattttctgatcgatgtatcttttattttcttcagtaaatctcttaatttaaaagagacatatcattacaatgatatcaataacacccgaatg

SEQ ID NO: 6889 - DNA, 1000 bp, Glycine max
  Soy_ogl_2580 Gm08:9555901..9556900 Cluster 32
taaagatgtgtaatttttttcccacatttaagttacataatatatttttcacataatataagtgtcttaatagttttaatcatgcatgatgttaaagcatttgataataagttcatttttcaccttgaaaacttacacaatttttaaacgtcattttttagtgccaataaacatgtcagtgtcgcaatatctttaacaagctaccaaaaaaaaaagtgtctaaatgaatgaaatccatgtcatctctttttgagagaagaaaagtgtttggctgtattacattcatgttaagagtatggacaattgatcacataaactaaaatcacctatttgattactatatggacaaaaatacaattaagtgagattttgacaataatttttataaacgggaaacattcatgtattttaagcatgatttttcgcttaaaattgggcaatattatttaccataacttccatttcaataatattttctaagacattaagcaatgagttgttatgacaacttaggagttaaaacttcacccatcaattatatgacacaaactcgcatggaccttctacatggataaattaaaagctacctctccttaaataaataaattgaaaaagatgcaaacaaaaacttaaaacacttccaccacgttctctgcttttattagttaatagttctggttgtgtacgtctttcaagaaacaaaaacaaatagttctagttgctattcatgtgctatttgattttactcccaaagaaatattgaagccgaaggaaatggatagagaaattattctttgctgtcattactaaccataaccatgagggtcctcatagttcaaaagggaactgctggcatcttttgttgtaagtatctgattgtcaagtgagtctagccagcaatgatcatttagtatatgtcttgctgtgacaaaaactgcgaggtttttgttttattatttaccacaagttgttggatcaaagaaaacttcttagtcatcct

SEQ ID NO: 6890 - DNA, 1010 bp, Glycine max
  Soy_ogl_3372 Gm10:5019572..5020581 Cluster 32
acaccacacaatcagcattgactgtcacatgcatgagacaaaaattggtataaacagtactatgtaacgtgtttataaactaatataactataaaggtaagttaaattaagcatgaatttcacacattagcatgtgcggcagctatatgctgtctgcttccaagtgagagatttctcgttagtttaattccaatgcatgataaacaagtaatgtaagttacactttagtctacttataagaagtttgaaaaccaaatcttgcaattaaaaattaaagggtttcttttttacatacaagatattactatatcgggaagttatgctatttccttgaaaaagaagaacatcagttaagagaaaacttatttttcacatgtattggtttaaaggactcaaactatttgatactgtgtcacaagctattaaaattaaaggtgcttctatatgtttttatgattttaattaatccccccctctataagggtattaattatgaacgtgttgccagaaactataaaaactgtaagtacaagttgtctggagtaaaataaatgtgcagtgcaaattattaaacaccaaagaaatttactcatgtgtccacatttttgttgcatgctgataagaaaaggaaaagggttcgagacttcgtttatatgcatgaatgtatgcatcacatcacaatcatatgataaatgttggcggcaagacgggttcctcgaagtatcgtttggttcgtgaccacatcattgtctgtgttcaaaactcatgtgtccaagttctcgtaatcttctcggattgtcccctctgtttttatcgcacgaacttccctcgctactcgccagtcactatatcactacgccacagtttcgtgtcattttaagtgttatactataaactaccaagggtgtttcgtttatcttaatcatacaaaagacttgtttctcggttttttacaatagaaagtgtgattattttgtttggcaagcttcaaactgcaattcaaattcaaa

SEQ ID NO: 6891 - DNA, 1400 bp, Glycine max
  Soy_ogl_4837 Gm15:350901..352300 Cluster 32
aatcgttcgagttataaagcgtccgctgtcaagttcgaatatgtccatatttaaattattttaattttaataccaaagagtgcactatctttctctaaagaccataaatcaaataaccaattaatagcagctttattcgcgattctcttttttgtgattagtggagagacctcgtattagtacacagccagggaaggcttatatacaacaacccattaggtctaatctttttgtcttttattgacataattaatcaagtaattagaaaattaaaaactagatggatggcctaccaacaaaaccaataagaactgcacttaatcatatgttctccaccttctctttcgctgccttttcctaaacaattaattttccccaacacagatgctgtgatcttctgctttaataggaatctttcatttcttttcccaaatacagaggattgaaaaagaagattcaagagagaattgagggagaaaaagttgagttcagatcttcccacaaacaaatacagaggattgaaaaggaggaaaaacttcactttgaatttgagtgacaataaaaaataatccaagataatgaatgggctcgatcagtgatccctactaattgtaaattttagaaagactttgactaagaatgtttaatcaattattttttccattctctttcttttttttttttttgtgcttatgtgcccgctgagaattgagttagaggctaacctgtcgaggtggaactcccgctaaagagtgaacttgtactattagttacttttctaagtatatagacctgaaaattgaatctttagctgcatatctaaaaaacataattatttatcaaccatacctcttctaagctggttatatctttcgtccataaccaattacaaatactattacacgcacacagcaggattttcagggctgaataatttgaactatttatacattataatagttattgcagttactagaaattaaggagagcagatttcctgctatagacgaggttgtcctttgcatggctagttaatcagcctaaataacaaatcgtatgtgattcagtttcagggtcttgaaccactaattcatgctacttattgagtcctaattaactgattcatatggttgccaatggtgtggggttaaactttcaatcttcctaacacctggctccaagcaatcaaatgtgatagcaaaacgtggagcaatcagagccagcattttcttctctcttgtccagtgagtgaaaagtagtcactctcttttcgcacactgtgaaactcataattagtagggaatgacattgagattttcttcaagaccaaaaaactgagatgataattaagtgctctatgcgggccattttgacatatatgttgcaatgaaatgtgaagg

SEQ ID NO: 6892 - DNA, 1200 bp, Glycine max
  Soy_ogl_5916 Gm18:3050201..3051400 Cluster 32
aacttaagctagtggccttaaccttgacaagatgtaaataaaatgaagacacagttatactgtaatcccttttaaactaaaaccagaaataaagtgaagttcagtttgataatcttgatgcaacacattgaaagcctcaaattctgtgcattctctctgactataatatgaactaatggaaatactagttcaggttggaattacttataataacctatagttattgtcaatttacatttccaataattaccaaccctattgtagaacatcctgactgtaaagatagaggtatcttcatagatgaacatacagcaagcaatgaacacatggaatgtaaactgattcgtataaataaatcatttccacttaaactggatagaaaaggctaaacaaaggagaaaataaccaaacttgcgagttgcaacttctacggtgaaataaaaaagaaagactaacatagtattgaacgaaataaagtataccaaaaacacatccatgataaatgtgatctccaacactaatgaaacagtaacaagaaatctgaagagaggaacaacagtgtttgttagtactttagtcacgcgtcaacctgcactcaaaatggaataagctcactatcgaccttggtgaattatacatcttttcttgcagagggccttcgaacactagacacttcctcactattctcacctgattcatcatccaccatttgatgtattttccttctttttgtttttgtttgatttaacacgaattcaattccttcttccaatgtagctctcctatcttcttcgttgttccacaattctcttaccatgaacctcccacttggattgtattcattcatttctatcagagctgccacgaccgctttatatgctccaacacccatttcctttttcaatctttttagccttccatcttcgtcatttataatttcctgaaaaaaacccagttcatacacattctcaacttctttttcatgatattcattaccttgtaaaaaacatacagcacacaaatgttaacgggatgagacaaattctatcaagagtgaaagatactattactatcatttaaggagatcaatgtgtctaacaaagttgcacctttgatttcccaccaattgtgactattttgaatggataccaatgggggtctcccagatccttttgccataatgaacatgtctccaaagct

SEQ ID NO: 6893 - DNA, 1400 bp, Glycine max
  Soy_ogl_367 Gm02:3970901..3972300 Cluster 32
ttcctacatctccaaatgcaccgtagaataatgacaattttttgtttgaaattatctatcattgtgttgaatcttggaagctaaagaatttcatagtagcgcggctgtccatatggcacgagcttgatgacattgagcaaagatatgtcattcgttttctggaattgagctgcaataacaacaggaattgtcactctgcactcctttcttctggatgttttgcttacaaggtagacaacccctcaatatactccaaagaaagtgcttgaattttggtgggatcttcaatctccaaatttgcatccagtcaccttccacctttaaatgttcattgcccaacatattctccataaggtgatggcactaaacgaactaagtaatctccattgctgccaagcctccaaatgattttatcttgtccaacaatgttgactaaaggcatttgttgtatctctttgacatcttcattgaatatctgttcgagaatttcacttctccaacaattaaaatcatgtctgatgagagtgtttaccttgagttgttcgaggccatttggtgggatagatgaaggtctggaactgattctagaagagcaaatccatggttgattccaaacagaaattgatttgtcattccctactctccattttattccctctttgataatacccgtgaagcatggatgctacgccaaacgaaactaggattatgctcaacatgggaatccacaaaatcacaatttgcaaaatatttagcttaaaaaactttgtaaccataacatcttggttggtagttaatttccagccttgcctccctagcatgactagattgaaaccatggagatgtctaaaacccatgtcaccattttcatttttcaaactcagcttctcccaagataaccaattaattctttttcttgcatttccattttttcccaccaaaatgagtttatcattttttgcagttgatcttctaaggtggatgtgagcaaaaaaacactcatgcaataggttggaattgtttgagcacaagatttaaggataatctctttagctgctttagataagcacttcctagtcctttaagaaagcaaagatagacctcttcttccttccaatgatagatgagagtcctaaataggtgtcactcccaatggtctgtgaaactctagtagaacttgagatgtgttgcctcataaagtcttaagtgttggcactgaaaaagatttctaatttctggtagttgataagttgaccagaagcctttccatatttatcaagaatggataataaattggaagtgtcttgttcgtctgtcctgcaaaatagaaaacaattgtcagcaaataagaggtgtgtaaggaggggagcccctttacacaccttgacaccatggatgtc

SEQ ID NO: 6894 - DNA, 1400 bp, Glycine max
  Soy_ogl_916 Gm03:36805301..36806700 Cluster 32
ggtttcagagaaaggagagactggttgagtcttttcaagctaggaggacgattttcttaaccgtggtacgaaaaaggtgaagggaggataggtttgagaaaacgtggtggtgaccatgaacttatgaatgtataactcagaatatgactaaggttctagagggtggtccagtgaagcattgtgaatttgtgatggtcatgtgattaattcctcttagcgacaaggaaataaatttatgggcaagcccatgaaaaaatacgcttaattagttgttaaggtgttagggaaaatggttagcttccacactttggaatcgaaactttagaggaattgcactaagaatgataaaatatttattaatgatatgtacaatggttttttccaagtagtttttagtaatgggaggaattataaatttgccttactggaaggtccttggatggtggttgaccaatatctaatagtccttggcaatcatttttcttgatgaatgcgaaggaatcaaggaggattacaatttggattcccactgaactctctaatggtatttttttagaggggttgtggtataaccctagctcgggaattatgaaggttaatcctttgacttcggttcattaattcacaaggtgaaattggtcgaatttttgttgtattgggccatcataagcctttggtcactcttattgttgttaggggttatcccctttacttaaaatataaaggtttacatgtaatttgctttcggccggtgtgggtgatttgggcacagagaggatcaatgtactgagttcataggaaacaattgtaataatcaggggggaaataagacgcataaaaggtgtcaatgaggtagcgtatgcaaaagaaagcaagggttgacgtctgccctactttctaaactaatgcaaaaaaatatggatcaaactaagtcaacgaatcacctacagtctatctacagggtaattagggttcatggttaattgttcaacgtaataacgcgtaaaataaggaggttacacaaagtattaaagattcttccatttgggatgttgaagttggctttgagttatagcttttgcaacaataaattttatccttttcttgagatcccctaaacttcgatgtaactcatggatttataacaaacccgaaagttcatctgctaacttaagagtactaagatcttttttacttcctaactaaatggatgtgattgtaggttctcaatgattaagtaaacttcagaagtttcatgagctaatcctctctattgtagtttcttctcaaaggtgtacatgtgtttattgttataactatttcgagcagttttgaaccttttgtgggtattgataatgattattgcttggttctcttatgcatagagagtgccttgatta

SEQ ID NO: 6895 - DNA, 1308 bp, Glycine max
  Soy_ogl_1116 Gm03:46846293..46847600 Cluster 32
agcttctcgcaaccacccccttgtgaggtaatattaattaataatttgtcatttattcatctttctctccgattacaaatcaaattattgtaaaagaaatatccaacacgttgctattgaaaaaagtataaaacactgcccaatcaaaactctacccaaagataaacaataagcaacaacaaatcccaataattcaatgtcttgaagctcctccaaccactaactatgactacataacttgattttttatcctgaattgtattgattttcacgccaggtcgcttatatccacactttgcatacatatcattcgttaaaatgccaataacaagtaccaaatctcaaagacttaaactttgcaaatcctcgtgttatttatttacaatgccaaatactccccactatccattatcagactttgctccccactatccgtaccaactttgttatctcatcatcccaaaccccgtgctcaaaaggccgaattgctaatatatgcaaggtacacccccaacatatcatgattcctattcacagaaacacccaaccatattcccttatatctgaaaccacccaaccaccaaatgtaacctttatccaacagcttaacattattccagacattgacgtggagcataaacccagcacaacaaaggatatgataattttcgagtactatttaaccactgccaagagagaatacacatgtatatttacagcaataattgtaatgctgtctcaaagaaatgcaaatcccaatcaaatcatgtagaggggagtgtaaataatttcaagaataggttttctggaagagggtattttgggtaaacaaaaattgaaaggggagtgagttagcaaaaaggagactggaaatagcacttacctctgaaaattattccaaaactgctgcacacgggttaaaaaaattaggaaattgctaaatacgtctccattgttttctttcgcacccccttactttgtcttttaaattttttattacaaaactaccctcatatcctctaacctgtctcttttgcatacctgcatattgtatccactcacgcacacccccctcctatgaccctttcagattcatccaattgggcgcatcttatattcctttccccttccttaatatcacttttttttctttgacaaagtgattccaaagctcaaaatctcactctttcataccgttcaacacctttctccttcaaaattgtttggcccttatttacccaaatatatcattcaattcaaccttggtgatggggtctcctttggtcctagcatagtgtgatgatgatg

SEQ ID NO: 6896 - DNA, 1073 bp, Glycine max
  Soy_ogl_1800 Gm06:5984728..5985800 Cluster 32
gttaaatgaatattttaaaataaactatataaattattctcactcaatcagtataaatgtataatctatatgtgatagatgttcaatagcacttgtacacaaccactgtaatattaatttaacacatcagaaaaaaaaaatgaaagaggtgcaaatctcgtcacacgctttattctctcgtccacgtgcttttatatggttgaaaaatataaaaagtaccatatatacaaaattgttagacgacaggataagaatgtttccaatttacaattaggcacagtaccaaaaaaagaattaaaaattaggctgaaagactgatcttttgttctcatcttgaaaatcagaataagaatagtctcaaattataaaacatggatatctacgccgttcaatttcaaaacggctctaaagagttctacaaatcgtaaataaatactgaataattgatatatttgtttataaaacaatgtcatcatataaaaaaaacaattaggtaaatattttcttaataaatgcttatgccaaaacgaataaagaatagccagcaaaagaaaaaacgtgtgtgtatatatatatatatatatgactttaaattatagtgcgtgtacataattcaagcatactaaattttttatttacacaatctaaatatctagtacatctttcaagttcgaacttaataccagctattatttattaattataattataattaacaacactttattatttaaaagctccaagttttgacaaaaacctctcttataatttttgtcgaaatcttggtttgagcctggccgtaagaaccatactatagtagaagtgacatattatcttgcaaaaaagaagtgacatatattatctttgcccgatcatgtttgactttaaacctgtgaaccatgtagaaatcttgcaaatctctccattaagcccttatgatctgtatgccataaagtacattgtattttattggtgccacttatttcaaatctatatttattaatcgacacgatttatctctccgctcaagtccactttcattaattgttatggaatacgccacgcgttatttg

SEQ ID NO: 6897 - DNA, 1100 bp, Glycine max
  Soy_ogl_3610 Gm10:47739301..47740400 Cluster 32
ttgactggcacaaagacaagcactgcattctcagtcagaatagaatacttgtggttgccttttttccaccaaaagaacaggagaagatgtgaatcacagtcttaacaatctggctgtaattagctttcacagttgatcaccaagacagcttgccacgaggcacttagaagtttctttgatttcccatctctccacaagttttaaagcatcagtcaaaacactgagattgtggtatgtgaatatgtgatctttaagtctaagtatgccatttgaactttacattctacaatgaagtggtatggctaattcaacaatgttctctcaaactaaataagcaaggatgttgagatagtggtatgtgaatatgtgatctttaagtctaagtatgttcatgatgcctggcacctcaaaaatatcaaattcttaaaaacaaatattattcatatcccttacacatgtagcattagcaagtatctcattttatattttacaacacttagatgtaatatgtgattacctacatatcaaatcacatggtgtttgatttgatgtaaaccagtcagagaaggaaagaaaaaatagtatgacaccaacagaagttacttcatttagcttgcttcagtctgcaatgcaacatacaaacagatacacattgcaaaacttcatttctatgatttaaaatgtttaataagccaatcaacagctgtatcaatgttagtttgtttacttaaaaaacaataagcatcagaggctgaatgaaaatgcattaattgggatgaatgatgggatacattaacaatttaacagttttggctgggagtttttcagtactaagtgacaatttgccactgaaaatgtaataaaataatatgttacaagtcaaagttggtctaaaaatataaaaccagagggttaaagaagctaagtctttgataccttgactagaaaaacaagttaatcttgattgacaattgcctatccaggtaagaaaatctaggcatctggtcactcatgtaatcttactgtctgaagccaatgtggcatgcataaaattttttaacagaaagctaaacatagatttcccttagccttcttctccc

SEQ ID NO: 6898 - DNA, 1054 bp, Glycine max
  Soy_ogl_3707 Gm11:3706347..3707400 Cluster 32
tcaaatttctagaagaatgttttgagacttggaagaacagtcttagcccaagaacctattttcttttgtcttctttcaatcttgttcttttgactaaacaaacaatattttagcataaaaagaattagcggttagctaggagagaatataatctatccctataagcaggcatactcaaagataaatgataccacacctcagaaatatgcttcaacaagaaggaaaaaaaaaaaagacaaacagtttacccaatgcatctataacgttccttaattcatcaactggtttaattagctagtatattttttcataaacctcaacatgactgcttacgagaagtatatgcacggccacatgcccacatgggatggttattaaagtacttttgtgagttttgttagcttggtagcttcaccaaaaaaaaaaaaaaacttggtgatacagttaagaaaatactactaataaaaaaaattgaatataaatgacaaccttttaatatccgaaaatcaagcttgtttaattcggtaattcctctttgtttaataaaaactattagtcgccatattaaaaattttcgtataattattctttttccccagcagacaaaaaaagaatctaattaaacaaacacccaaggaaccattcctcgcttgaaaacattcagaatattggtgttatttcatggatcaaaacaataaactcaaatattcaaaaattgccaaccataaacacttaattttaatttgtccggaatatttttatttaattagaaatacattaaaaaaaagtgaagtgaaacttgaaagtctctaaaaagttattggattggtagagccgaatcattgggctttgccatggtttagtccgaaacacacgttttcttttagaatcggaacaagcaacttaaagtttaatgaaattacacctaatatcacccttttcataaagtcgtgtattgattttgtcaatataaatctctctaaatttcttatgtttcaatatgaattaagtgacatcaacatttttgggattcatcaaaaaaagaagaaagaaa

SEQ ID NO: 6899 - DNA, 1100 bp, Glycine max
  Soy_ogl_4469 Gm13:35959401..35960500 Cluster 32
tagtggcataataagtgtttcattttaaatgctcaaatgtggatgaatcatattttaatatttgagcacaattatgaggtaattttagttagttagagtatttgtctgcctaaccattgcatattttggtacccctgagctaaggggagaaactaacagagattacctacttttgagcgcaacataaaatggtgtaagttttaagtgaattgataacatggtcctaaaaggtatttggtgtagagttggaatacgaggcgccaatggagtgccttcttgttgtcatgatcaaacctttgtgtttaaacactattgtgatagtaacctaattaagttcgtcctatgtaaatttgagtgtctttatgatgacaattcgagccttaagcaattacgggtagatgtataggcatggagacagcaatcaacttagtattgttattaattatttacccaattataaattcatctccaacaaaaattcttgcaaatagatcttaaccttaagatatgatcttgttaagatttagtattgaaacattttgttggatctccacatagataccagttcatttacaagaactcccaagatatgcaacaatttttaaaaaataattttttactctctctctttccataatatcccgtgggaagcaacaagaaaaaaatggagctttgcgggagaggagaataactagatacacaacaacaccaacacatatctcaaatcataaatgattaaaaacgaacaaaaaaaaaacaaatatggagaggggacatcattgaatctgagaaaatccctcttcatggctatctagaaaatcaaaatgaaaaaaatgacggtaaaaaaatatctggtcgctaaacaataaaaaaatattgatcaaccgcgactgaaacaaatgcagttattatttttaagtctcctcgattgaatttgaatcggctgaggagtcaaataaaaagataaacacaaaatccgtctttatatttttcaaatatttttgttgtaaaatggtcactaacttgtgaaattgacatttttgtcattgatgattaactcgatcgtcatttgtcaccaatatgtttcggttgctatttta

SEQ ID NO: 6900 - DNA, 1000 bp, Glycine max
  Soy_ogl_6497 Gm19:42129601..42130600 Cluster 32
tagctactttctctttctctcttgattggtctgtgaaaatcagtaccctctaagatagattaaagaaagtaattcaagttggattgtagttgtttgaaaaaaaaaaaacataagagtggaagcaagggaattaataaggggccttaggtttgaagaaatgaagtgtgcgtagtgcaatgcaatgatgtcacataagtatgaatgaggaataatgaagaggaaatggacatttgggtgtacaacacaacctgccaaaagtgcagttctagtgaaagctgagggaatgggttaaagtaagctagtcggcgcacgtcactttcctcttccattcattcatttacttttcctcacccaaattcaattacctttgccatctacctgcactcaccaaacccaacctcttcccaaaccccagagagaacaaaaatacaacacctttaattactctcttcctaaaacgaattttcaccttatccccctcttatgcggtgtatttgtgacaaccaacaatcatcttaggtgaaattattttaacttaaataaagatattgagttcaaatcttaagtatattgtgttaaatactttaaaaaaaatattcacaataatcttatttaattcaaataagattgttttcaacaaaaaaaatatagcatgtttttctcctgttgaaatatcaccgtaaattcttcaatagtttttaagcaaaatatgttcactagtcctactgctggtcactgttggtcaatttttttacagttctatgattgggccttggccactggcaggctcatgatagctggtccacaactaattggaaatggaataagccgactataatcatgttgaatgtggctaataaagggcacattgctttgttaatgacacccttatattgataagtattgtatgtgctcttgaatataaataaataaataaaaattaatttatacttattaaaaaatttagttaacattatttaattacactaatttcatttaa

SEQ ID NO: 6901 - DNA, 1200 bp, Glycine max
  Soy_ogl_2592 Gm08:10336101..10337300 Cluster 32
gaataacataattaaaaaatatttaactaacttataaatttaatgcagcatgtacaaattttagataaagcatgtataaacattctaagacgagtatgtttggatttttagtaaagtattttaaaaatatatttgaaaataaaataagaattatgtttaataatctccaaaaacatgttcaaaaataaaattttatctataaactcatttttatgggaaaaaaaaacttaacatacttttataaacaaaagtatacttaaaatttaagtttacaaaaatgtaattcaaacaatagtaaattgaaggtgggggcgatagaatggcatgtggtgacagaaatccatgaaaatgatggcttggctgcagtgtacagtgtttctctctcaaaccgaagtgaagaaaagtccccacttaacatttccttcttctcatgacactcaccacaaccgttcatgcttttggatgcaccacttttccttggctttcttccaccattccccaaacaaagaaaaatggggcccaccaccatccctctcccaaggacagtgctggccccaccaccttcccaaaaatattgcttttgcttacactctaactctgaattctcccttcattcaatcaagtttccatgctacaacttgcaacttccaaccacatacacataagataaatctaatttgtcaatggagttatatttagtgaaataaaagtatttgatttttattacatgtcaaaaatttgaataaatagtaatcacaaaatcagaaatgtaattaatctctaattcaaaaatttaaagatatttgttattttttgtaattatttaatactagtatacatttaaaaaataccttccatttactattttatgaatatgcacattgtttgatgaactcaaatatatgcaaatagtcaaacaccacgcaatttctctggcaggtacatagtttctgttacataaaatttaagtttagtactactatattttacgctttttattatccaatttaagtttaggcttaaattgttagtgatggtttgtcgagatgatgacccttggggagattgtcttgtatgaactttgcttcataattgatgtggcagcagctcttcactttaagaaaatatatataaatatatatttaatattgtgatttttttactttctctaattttataatttgaacacattgtccatct

SEQ ID NO: 6902 - DNA, 1000 bp, Glycine max
  Soy_ogl_2855 Gm08:41749501..41750500 Cluster 32
ctttgttgcatgacttcaaatcaaaagacatgtttaaaggtatataaaccctgagaagtgcaattgccttaatgagatgaattcttttctcatctgaagtatataaaccctataagatgactctggccctaaaaatggaaaagtctagcagtccgtatgaaatatattctttattcatcattgagatatattgactgggatttctaaaatctttgtttattgtgacttttttttgtatcaaaaagaaagtgtgagatgaagatgagaatggcatcccaactatgttgacaccccatcaacatctcgaaaagcacacaccatgaatatcattgcaatataaaaagataattgaacaagcacttgggaggaccaaatcgagcccaatggatcaacactaagagaacctatagtgaggaagctcatttttacctaacgaatcttgtaaaataaaatttgggggagaatcccaccaagaaatatctatattttgagcatcaaaagaggaaagtttgtccacaccagcattgtcttccctaaaaatgtgagatatttcttggtggcaaatatataccaaggcacaaaactctgggtagtgaaagcaagagtcaacaacttggaatcagttttcagccacaaccaggcctatttttcttcagttgttttcttaatcacaattatgacaaccataattttttatcataaacgcaaattgaatgccaatattgacagcgaaagctttaataaacattatatcagaatttagaaaaataccaccactcagccatacttgggcttcctcttgcaaccccatcaatattgcattagatccagggtagtataggtggcctccaaataacagttcctattttgtctgctttccttggatgacagaccatcaagaaatgcttaaggatttggaaatcagcaactgaattcttcatggttcctttagaagtggaacctgtgatgtgaactcatgcagtgatgttgttaagcgctg

SEQ ID NO: 6903 - DNA, 1059 bp, Glycine max
  Soy_ogl_2420 Gm07:38333942..38335000 Cluster 32
tgttaatatgttagaggagcaacatacaagcttgcattttgtaatcaatattttgtctcccctttctttagtttcagttttctccaatgattggtgtcaagatatacttaaaaaactctaaataaaaagaccaaaaaagtctttaagaaacatatatttgaataaacaaatttttgtttctctttttcctgttcttgcttttcctcataaataattagcatggccatgaatagtttcttaatgaaattagtgagatatatttgtaagtgatcacctccatcgttgtctaaaaaatgtactactaaatttatcctcggaatgagtggtacatcatgaaggtgttgtgatgttttctaattgtgattgatttcattggagggtgggcggtgattttatgttagtgatgcctattgttctgatcatgctcaataacatatcaaggtagtgaggattttgatttgctatatgagtcccttggcagttgggggtggctttgctgaatatatactggtgtagtcatgaatcatgtatgagtgtgcttggtaattaaatggttgctggggattctatgcttgcagataaggattacggataagtggtttttacgggatgggtacattagcttccgttatgctgattcagttggaagtgtatcataagcttttggaaatttattgatggaacaggatgcggtgctgcaatgcagaaagtgtgttgctttataggagtcaaaggaatcacaaagtgagtttgttggatatttgggctgccattcctttttaacaaatgatagcagctccatggtgaagtataaggtttctacactgaaactttggaaagcatggttgggtaggtgtcagataacatgaaaattgaaaccttcacatgatagatagtagtgtaaagctagatattgtggtctagaaatgctttaattagctattgtttctatattgctggtttgttttggaagttggcataaatcaatgatgcatagatctgtcagttggtgttccacggttatatatggtttattattgttcttggagtctatgaggg

SEQ ID NO: 6904 - DNA, 1077 bp, Glycine max
  Soy_ogl_4406 Gm13:32254801..32255877 Cluster 32
ataaattgatgaaatatttgttggaaaaagaacatcttataacgtgttgatgtcggcagagatttgacagtgagaacttcattctcacaccgtacacacatgcagtgctataattcatttaatcattttaggttctactagtcttttgaaaatggtttcacattttgaatgaatggaaggaagaagaggagggtggtagaaggagcctactttgggatctccttttttgagttgtggcagtgggaatggggtgagtgattaaagaagttggagttgagtacaatatttgttttcatgcatgttgtggggctcccttatttgttggaccctttttttttctgggtatggaatggtgaccaggtagggcactatctacaataatactcctagtaaaaaggtagggtctgccttgccacccccaacaaccctaaccccaccctttttattatatttttaggtagggagttatttatattcttgaactagaatagcatatatatcaccattctatcataacttacctttttcccttttttttttctttggattaatttttcttttctttttatcagcaaatattaattattaattttttaatttttgttaacaggaaatttgaatttgtgatctatccttctttttcattattttttaccacagtcaattttatatctttttgactttttagtctctctagccttcctctgccacccacaatgacaaaaaacgtttctactaacctctcttaacacgtgcacgcacacatgacacaccttatcttaagtttcttgtttcccactgtacaaaatccatgctgcacctccactcgtgtgtcataaaaatatttccttaagcatcctataaagttatgcaactattatattaagtatatctaaaaaccgtttcaagttgttttgggacgaatgacaaaactacacaggaaattgataatacaatgttgaaaaggtagtgaaacaaattgggctaacgagtcttgtgtacgagaggtacggattcttgctacggagggtccttctgtggcttaattaagtagcaataatatatgttatggacggg

SEQ ID NO: 6905 - DNA, 1100 bp, Glycine max
  Soy_ogl_395 Gm02:5237601..5238700 Cluster 32
tacaacttaaatttttatccatatataatttcaactgttatgtgacttccactatatgcctgtgatgctatccactatatgatatagatgattattggctttccaccattttccgcaatccccaattgataacactgtcagtttccatttccctcagagttggtgcaattcttacttgagaattaacaacatcatgcattcctgacaaatgcatgtaccaaactcttacaacaaaaaactaaggttcttataatgcataatgcctaaacacaatgaagccactcacataaagaaagtaattaagttatctaataatgtaggttctaacttctaacaccctaagccaaaaacaccaagaaagtggatagcaactcatcttctgaaacaaactatagacatcacaaaatgcttcaaaatctataataggcaatatgcactatgcacaacctgttgatgagatcaaagaatattatgactgtagatatgtttcagcatgtgaaggagcttggagaattttcgagtttgaccttcattacaagtggctgccagtgcagagattaatttttcaccttccaaatcagcaagctgtttatttcaatgactatgaagaaattgagtcatttgttgaaagacatgaacaggttcaaacaatgtttcttgcatggtttgaggcaaacaagaattttgttgtgggtagggatctaacatattcagaatttcccactaaatttgtctattgccaaaaagaaaaaatgtggcaaccaaggaagaaaggacaaagtattggcacgcttcagtacattccccctggcattggggaactttattacatgaggattttacttactatgcagaggggttgcacaggctacgattgcctgaagacagttagtggtgaaaagtataatactttccaggaggcatgttatgagttgggtttcctagcaaatgatagggagttcatagatgcaatcaatgaaggaagtgaattggcaactggtaatcaatttcgaaggctatttgttacattgttagccatgaatacaatgacaaaaccatctgatgtttggaacgaaacatgcgagttatattgtgtgatg

SEQ ID NO: 6906 - DNA, 1200 bp, Glycine max
  Soy_ogl_3837 Gm11:10820001..10821200 Cluster 32
atattagtttgagtaagttaatttggtttagatgcatccctcattctaaatctttcatcttatggcgtctttttcacaacaagcttcctactgacaataacctttggtgtagaggatgcttggttgtttccatgtgcaacctgtgtggttattcttaagaaaccattgatcacctctttttgaattgtgtttttgctaaaaggctttggagttggctgagtaatgttagcaaatctattgactgctattcatttgttaatatcatttctctttgcaatagcagttgggctcttcaagtcaatgatattatcttgtcttcaattataatcattgtttgggctatttggaattcttagaatcagttgcaatttcataattccaactgaagctttgaatctgttatcatttctgttcgtgctaacgttaaaatttcaaggattatctctaaaagttgcatgtcttctagcatgagcgactgagcatcttgaagttattttcagttgatggaatactcccaagcatcctatcatcaaggaagttggttggcatcctcctcttcctctatggacaaaatgtaacactgatggtgcttctaaaggctcctttggtctctcagcttgtgcgggcatctttcgcaataacaatgttgattttttggtggcttgcttctcactatggtatccaaaatgctctttttgaggaattggtaggagctattcttgcaattgaaaacgttgttttgaaagggtggaatcacctttggttggagtgtgattcagttcttgttgtttatgctttcaagaatgaaactatcgtcccttggaagcttaaaaataggtggagacattgtatagctttggctaaaaatatgaattttttggtaggtcacatttactgtgggggcaatacatgtgtagatttatcagcttctgagggagtaaatactcaagatttttatggtgggactcccctcctagtttcattggagcagagttcagtagaaatagaattggtttccctaactataggttctcttaagttttgttccatgggtttggttcatgtccccatgtgttttttatttggcttttctttggtcttttatatattgccagcttgcagttcaggtttcttagtggcagtcgtgctgacctagttaggatcattgccactatggagctttgcttgctgtttttggta

SEQ ID NO: 6907 - DNA, 1000 bp, Glycine max
  Soy_ogl_3441 Gm10:38092001..38093000 Cluster 32
taaaggaatggataccatataccatgatataataaggagagaaaaacataaagggaggatataagaaagtatcattagcgcataaataagttggagtgaggttagtgggacctaagttgagttgaaggtgcgcaaattcccctcagaaaattataagcatgcatttaatttttttgtattttgctactttatttttatatatttgaacatattaattcttaatttctcagtacattgtcaaattgttttttattggttagtttctactattttacatcctgtttcattttcaattctttgaatactttatacttgattcagacatttcattccatgataatgatatatatttttaatatagaaagaattccttcactaagcagggtcctgattctgaatccactaactagttgctttaaattcaaactatagctaagtatatagttatattaatccgtaacgaaagatgatgagtatttgtaatgtcagggtgaagaacctagcaccatgcgcacaagctatgtcaggtgggggcctaattgtctgttttggcggcgtaaggtgtccaacaaaactgagatatagataagtaatttatataagcatcacaacacagggttgatcaaccggtaagaataagattcagtgggccatgcatgtcaaattcagggtcaaatctagaataccagcatgattttttttctaatttgttttaactcagaacagaacgtgcaccactgtccaaaaacaggttattaatgatattggcgtaagaatatatgttatacgcactcacgaaatcttggtagaagagccgtaatctcagacactgatgatgagttgtgttgattgcttgtttaggtgatcatatatcatattttggtcataggtcattactcattaaagaatatgtccacttgaagactcaatgtcttaaactcacccagcaactctctcttgaggagcagagtgtataaatgcaccagcatatccctcggcc

SEQ ID NO: 6908 - DNA, 1176 bp, Glycine max
  Soy_ogl_1689 Gm05:37089541..37090716 Cluster 32
tagacctctaatatttttccaccttgactccatatagcaagaaggatcatgttgcgtgtagacaccaaatttggaataatgggaacttcctccatgacccggggcttcataaacctgaaccccatcaacataaatcttcacattggaggcatcctcgtcatggaaccaggacagaattattataatacacgaacatcaagcataaaagtggtggcacgtttaggtgtgccccgaacacttgcataatgcacacccagaagtatccttaggcacaaaaccttgcccttcaaattgccatacccctcgtgaataatcgtagccctgcaaggtatataaataatgaatatattacaagccacatagtgtgtacatttaatttaagcaaagagatcattaggactgcccattaaagcattatttaaggaattaaaaaaatatttattataaaaatcatatgataaaaagtcacaagtaatataattttacgcatttaaattaattttttcttttaattttttaaccaatgatctaagaacacttattagtatttttcttaagtttaatttacctctgtgcggatttctgaacgagggttggtattgctatgtggggatagaggtttgtctgtgacgtgcacccacagcttgtgtactccgtttttaaacctatagcgttctcttacgggtaaattataaggcttgtgatttttaaaattggagatgttgagtgagagttcagtgaaaccgagtgttaagtccactggcatgagtggcatgctccttgatgtggtgtgcatgactgatgcaaaatacatagcaatgttcagaagaactatctgatacaaagcacccatgtctttttctaaagtggaaaagcttggaatttggtgattttagtggatgctgattcagtgatgcagagagtggaatatatatagtactaggtatagcctgcagaataattataagtggaagaataagctaagcacatctaaagaagttaacttgttccaaccatattccattgtcgtcgcacatttatatctgcttggtagactgtgacttcctgagagtttgtatagtaggtttgaagtatagttttgcattttgcattttgcatgcttcaaaatgagtgccaagaatacttgaaatttaagtttaacttgtaagaaaaata

SEQ ID NO: 6909 - DNA, 1100 bp, Glycine max
  Soy_ogl_4595 Gm14:879401..880500 Cluster 32
aacttgcgattagaaagtacgatgcatgaatactactatttgtcatggtactcctcaatacttgtacctgtactaggcactattccgtaccacggtaccagcatttaaaaggtatatacatagttacatataacattatgaaaattgtatatatattgtgattgtgattttatacttcgtcattatatgtttttattttttttacatgaaatacatcttctcatgcacgtatctttgtcttgtcaattttgtggaaccattgtacccgaagctgtaccaatggacttgagttgtgttcctatatccatgcaacacgaatgaatttgttgcgcagatcgatctaggtggcaacaaacattgagatcataggaagagttagataatcagcaatgttcatgttcatgggtcggttccaagcttcagctgacaattcatttgtttggacggaagaacatctttatgggattgttcaagaatctctcttcaccatatctactattatacacgttcagtttagaagttggattcctcctcaaaaattgctcccatttcaaaaaatattttataatatatctattttcaattgattgataaaatatatttaaatgagattgattgtaagatctataaaaatgactcaaaaatctaaagtgtaatctgcattcgaaaaaaaaaagaaaaaattcttatatcttgtatgacaccataaaattcaccaaaaattattcaagaacgtacctaaaattgattctaccactgtaaggtaggtcagacatctcattccagcggatcagccagttcaaaagcctattgtagtttcaataataaataaataaataaagcccattgtaggtttcaagaataaactgtcattattttagtttctgaacaaatgtatcgtaatactgttatataattactccttgaaatctcacgcatcctcttcgcgcaagtagttgggttaggacttacgactgatgagacttaggagagtgagaagtatttttttttgttatgtttttgttgacagattcgcccttaggtgctttcggcccaaatcaaagtgaaaggggaagggatattcttcctgcacctttaac

SEQ ID NO: 6910 - DNA, 1134 bp, Glycine max
  Soy_ogl_6177 Gm18:54824701..54825834 Cluster 32
ttattttaattacactcataaatttcataaatattttgtcattgtatcatagtagggttattttgtaccaataacatgttgagaaaaaaaattgtgttctgctgtagtaaatttttatcttcttcttactaaattaatataggctagaaaaataaaaataaatgaagagaggaatgggagagctcaactggtgagttgtgacattaattaaaaagggttcacaagaacggctctaattggttatcgacttatatatatcgttgactttgaaaaacccagttgagttttttttctttatctagatggagccaaaggtttgagtgatcaactaattttatgagaatgggtcattgatttggggttgggacaccaaggacttattccattgagcttctcaacttattggttaagctcttgacctatatacatttattgaattcatatgccagctttgaatttgcgcttatgttatttatacttaagggtggcttggcttcttagttgcgtagtagttgagagaaaagtagatgctaggcattgattgtgaatggtatttccaggattctcttattttctatgaatcattattctctagaaaggtgcaagaagcaatttataggctgcaagaagcaagattgatgaagaacaccccaaaaataggtctattctcaaaaatgcacctaacaggacccaaaataattacaagaacattggctcctaccaaattggtcttggtgcagctatcagactaccctcttccccacctaggactgtgcaaaaatggatttggaaaaaatcaaactgaaatggttttttgaattgatttaatcagtttggtttttaacccgaatctgcaattggtttgcaatctagttcgaaatcgaactggttttaaaaaatcaattctaaactggttctaaactaaactaattttgaatacgtttgtatctgttttgagatccaaacctttcagagtcgaagtaaaatatcactagcaaataataagtaataaatataacaatatagttaatgttaataatttccccttaaacttaatattgtatactttagcttctaaatagactccaagagatgtttacaatatacatcttcaagcacatattcaactttaaa

SEQ ID NO: 6911 - DNA, 1000 bp, Glycine max
  Soy_ogl_12 Gm01:893301..894300 Cluster 32
ctacctctcagtcaaatctggtgactatagatggaggttaatcaacatatcaattaatcatttgtattttctctattctccctacgtcagtgtatatagtacctttaagtggcccaagaatccattaattttcttattttcacatagaaaacagaacgtacccccacacaagagtgtgggacagtgaatgcttaacaaccccctttatatttttatctttctacaggtgttaaatataacattggaattgcgattgataatttttcttacagtttgttcacatgcacccaagtttctgtcagttttgatgatctaccactaatatatatgtgtggctgacgtacagccagccaccccctttggcctcctcgtactatatatcctatttctaggttgtattttccttttgatacatgcgcgtgatccttgctgtctggtttgtctaataaaaatggagagtgggtatctccaaagcaccatgctatttcaacatcaagttccaactaatgtgataaaatgtcaaaataacgtttatattatgaaaaaaataatacaactaatgggatgaaatgtcaaaatatcttgatgttgcaatcacaattgtagaccgtaatttacaaccagacatcctaacaaaaacttgagtttattgtcttcattcttttgttttctttgttggacttttattctctcactctcaaaccgcactccctgactaaggtgactatcagactatgaaacttactgataaccttaaaccaataatagatcaatgagactcatgacatcgaccactaactcacatcgaccaataatagttcacacactataccggccactaactcacattttttcttcaatttccatcacataataccccttttaatttcaatataagtaaatgtctaaacatcacatcgctaatggtcaagaccattaaaccgaatttggagttatcaaagataagatagagagtgagacgaccatcgaggttaagaat

SEQ ID NO: 6912 - DNA, 1071 bp, Glycine max
  Soy_ogl_364 Gm02:3870601..3871671 Cluster 32
tatcaaatagtttcactttcacagtcaatcatgagtgacaaactatcaagtctcttcccatttctctattatcacttcaggaatcccaagaaacagcaggtgaggtggtcaaggtttcaaaagaccaagtaacatgaatgaaactaaaagcaccgtggacatttgctgttttaattctttaccttaatgaatggaaaggcaatgtatattagaccaacttcgctgctgattcctgttggatatagcactaaaaaggtgctatatctgctagaaaaaaaagttgcagtcaatataacaggaagtcaggaatataagaattaacgattaccatattatatacagaaggctcaacattcaaactttatacctgagccacaaaagccatgatggggcagatccaaatgcctctttcaagccaaagaaaaaagagcaaatgatctgcaattgcaacaacaatgatgatctttcccttcccttttcaatcaataattactttgccatcgaatacaaagagatatgtttatcatgagcaaaagaagaattgtagggggggcagggaaccaggcctgaaagctttgcttgcagtcacccagctcattgtcttacattgcaaactgaaggttcttataaccattaaatcactatattaacattctatgtaaatgtttctaattgatgccaccatgagtctctatttcactatttttgtttgtttcacatcaatgacatctcaggactatgatagatcccttgtccactacacatcaatgacatatttgacaaggtccaggccaaagcacgcagatacaaagcatgcagaagcagaggtagcgacaatttagatacttatgtaatataattagataggatttggttcagctatttagtttccctatttttctagataggatttttttccaatggatggttaaacaggaaaggtggggcatattgattgagttggccagcttactattgtcgacaattaataattgggacgagctgagttctaatatccaagacattcaattttgggacatatttaaggaaccctcttagttactactgcct

SEQ ID NO: 6913 - DNA, 1073 bp, Glycine max
  Soy_ogl_4459 Gm13:35400844..35401916 Cluster 32
gtttacagggctgctaatctaggttccttgtcttatactattggcgattcctttgctctggatgccgagcttattggtgctctaaatagtgaataccctttaatttattatttgaatacatatttcatttttaatatgtataaaatttgaaaacctagaatgacacatagttttaattatagggatgatatttttcttgttgatgtaaagaaagattctcatctcaaaagtcacgtcttcaaaacactgtccgttttgcttatcaccatattatggagtccatgtttttcatggaaaatcttaaagttagtggcagccggatgcagctctggagattacaaatcccacccaaaataaaacattttatctggagattagttcgtggatgccttccttctaggcaaagacttcaatctaaaaaggtgtttcatgccctaacttgctgtttttgcatttcaaaccctgagaacgagtggcatatctttttcgggcgtgaccaagttaagagcgtttggatagcagctggaatgtagaatctcattaatggcaagatgcagaatgcagaaggtatctttggtgtatttggcgtcgtagaaattactaggtttgagaggataatcaagtacaacctcaggtatctgtttccttagccatgcaatattttttctagtgtctcatgcatgatacatgtaaactcgcctatgatgaagccatgcagcagaaaaacaacgtcatctcgtcttggaacaaaccacgaactggacaaataaaatgtaatatcgttttggagctggaattgttcttcgttaagagctgatgagtttggacacttcataaaagcaaaaacagcttggcatctagtaattccagaaccgaaggaagctatataaagcgcttcactggatagcaaaaattggaattcagaatattgttattaagttagattgcaaagtcctcgttgatggaatttctgtctgctctactggtttgtcagattttcatgttctattgtcaaaatgtagagcttttctttttaaacttccaagctcagtgttagtttcatcagaggcata

SEQ ID NO: 6914 - DNA, 1049 bp, Glycine max
  Soy_ogl_4973 Gm15:10352615..10353663 Cluster 32
caacaagaatgaggatttttggaggtcttcggaggaatttcatgggctagcttggaagatatatttcaggccaatttctccagtaggaagaatatacaacattttggctaacatattagctaataaatggaaggtgtttcctggagtgattgattagagtcgggagcagatagtatatattattggatatactaacaaattattattgctctgagaaattttggattcaattcttctaaggaagattttaaattttttaacagaaattaattataaataaaatttataaatatttcacactaatattattataaaaagaaatattacaacatatggacgcttgtttattgggaaatagtatagttagctaggcagtgtccactagcattatattatgcacgagttggtgacgtccttaacttgaaccaggtacgtacgtacagtacacagaaagaaacaccaagatacgaaggaagtagctgaatatgatgatggatatatgtgaaacatgcatattctgttcctaatcttgttggcaattgtagtcgaaaatagtgttgttgcgtccacaggcgctaaaaagtatttgcgcgagtatttcagtggctagtggaggaaggatcccaagtgacactgcgcggcaaaagcaaaaagcgccaccaattataggaagagcggcgactgcggtgcagcactgattgcttattatgctaacacccaaaccaacattggaacactcaatcaaatcagggcacctgatctgactgctagggtcatcattttgggcagggaaagaaggattgaagctaccaatcatggaaaagaaaaggaggttgagggagaggagaaaagccacacccttgggacccattaatatttccaaatagatcttatagtggatgatcgatgagtttctcttgaatcaaccactgatgttgctagctgaactttgccagagaatttataggccaaggatctctctcgaatgaattaatttcttaaatcaaattaagttttaaatatgtttcaaatccttaataaattaacgg

SEQ ID NO: 6915 - DNA, 1307 bp, Glycine max
  Soy_ogl_5598 Gm17:9029994..9031300 Cluster 32
ttggttcctttcttggagaacttttagcccaatcgtctatctacatgtttttctccacgcttcatttcatcccaaacatctttagaattcaatctgatccaactaccaccgactgaatctgactaagattgcattcttattttcagctttcacctacttgatctcttttcccctaaatttggaattataattatgattttttgaattaaaaacaagtaaataatttgagtgtgtgtgatttttctccatatcctttggatcagatcttatcccgtttcacaccactcaacttctaagcatctagtgcttaaggctagggcattgtgtattctctagattggattgtatcccgattcacaaatcaaatccctccctaaattgggaataaaccaattataatcccactaaggctccaatcacatcacacactgagaagttgggaatatgataggatttctcaacgtaccatgacagcttagtctgagagggtgagatagacatagacgcaattacatcccatgaatctcacgatatggtgaaatattttgatacaccatgatggctcaacccattaagacggtggaagatacacaacccaagtaaagataaaaagccttctcttagacctaaaaaaacatgtcaaacaatacacttcaccttagtgctttagattagatctctttcattacaagaaaatcttttatggaacattcttcaatcaatttttaagtttagtaaacattaattaaaaattcgtattaaaaaaattaattatcaagaaaataaatttaacaaaaaacattaatatcatttaaggagggggaaatgaagtaggaggtgagggtgtgaattgaaaaaacagagaagaagatcgagaagaaggcagcagaagtgggttgtaagagaaaggggatgttgggaaatgatgccaagggtagataggtcttgccaaaagtttttgaaaaatcaggggtgagaataccaattaagagtctaagaataacaattctttaatttggactggaatttgcatatcatattggcagtatgggctttgttgctttctggcctcttgatttgaaataggtgttgataaaggaatgcccaatatatatgcaccataaggagaaacggccaacgagttaaaaaaatttgaaaacttatgactttttttaacaatattgacaagctaaaaagtgttgacttaatggcttaattattattgagttattggcagtgctatatccacttctcttatatactaatacactcccccttctcaatctttttttccaaggtaccttgta

SEQ ID NO: 6916 - DNA, 1213 bp, Glycine max
  Soy_ogl_3156 Gm09:37643288..37644500 Cluster 32
tatttttttcattcaaagaaatgtaatattatctaaggacaatagattatatgatatgatctctcattaatttacggccgttaaatgggatgatataaaattttataaatactaaaatgatttacttatctataaagaccctctcaattcaaattgttagatccttctattctctctctctagtctctatgtacattattttatcaacaagtattaattaataatttattaatttttgttaacaaaaaattgaatatgtcatcttttttttttctttcattctttcttaatcatcaaattagcttatatctctggccagtctctatgtacataagtatgtatacacatcaagaccacgtgactgattaatggcggttgacactgacaaaactaacctcagaagctatatgcaatctaacccactaaatttgcctagtagtggggtttgaatatcatggctaataaagggccattgtacgaaaataaaaggctatagaatctttttcattttaaagtttataattattttaagtgtaaagtggaaaaagtttggctaaagagaggcattctattacttgattagttatttgctaacaacacatgctttttgcgattcagaattgagagtaaagtccaatagtttatttttgcaaaattgattatttgaaccatatgcataacgctaaatatgatcagcaagcactgactcgttgattcaatcacataatgcagcaatgctatgatgcatgagtggggttataaggacttaaggggaagtcctcttcttctgctattgtaaatcaatgaagctagcttcatacattatttggtcctggatggatatttgagtattacttaattccttttgtagccccgatactcaaaaatgaccaacgtaccggttgaacaccgatattgtccaaatacgtattcaggaagtattgatttttttttaaaaaaaaaaaaaataacagatacgtcttggattcggctaggatacaacttaggttgggggacacagctcaagccgtattgggatatggctctaatatggcttgagctattttttgaattttgaattttaatatttttaaaattaaaaaaatgctaaaagtgtaggaattaggaaaaaaaaacattacttccctccgaaatatgcatatttgcatacatatataatttttttaacaattttttattaacgtatcaaaat

SEQ ID NO: 6917 - DNA, 1000 bp, Glycine max
  Soy_ogl_2740 Gm08:17159001..17160000 Cluster 32
tctgtcaagcatcatacgtgctaacaaatatcttcatcaattatgttaaggttatccattatcgtacgactttctttttttgtgttttttttcttctgcattttgtttttactatattttatgcagacacgcgtagagagagatgtgcagctagtcgcatacgtaccaccgaattaattaattgatatccgaccaaattgaaaaacagcggtcgacatagtataaggttagaagaattttttctttttacggctggttagaagaagtttatatatccaaagtgttgattaaattaattgtttaaatttgaatcaagattatttttagaagaagcaaacttatgtcatttcaacttgtataaaatcataaaatacatggaggaatatgatcaaacaatcggatattaacattaaatcaagatgttcttgtaagagtatgaacaatttagttggcttatctccaagtaaaacttatcctaaagtttgtgaaatttctaaaaatagaattgcattttcacagattaaattataaaattaatatatgcaagtagattaaattaatttaattatactatatagttttagtattatgtataattaaattatagaattatatactaccaagtcattgattctagtgacattgaatttaatcttttaagtaaaaaaaaagaaatttattcaaaataatcaatcaatcatatatttttccacattttgcattaatattacaatgataatttttttataaaattatatacttattactgtatttattaagttaagagttattattaatatataattattttaaaatgagaatattacacaggattgaaaatgctaagagtgtaatctaaatttatcttcaaagttattaaatttatagtggtactatttttcaaaactcatactcacggatttgatcgagacgagtcattggagtcaatactcagcaaacaaagagcgttgaaaagtgaggcatgaaattgaattatttt

SEQ ID NO: 6918 - DNA, 1047 bp, Glycine max
  Soy_ogl_3270 Gm09:43400354..43401400 Cluster 32
atttaatcaataaatcaaatatctccattcaaaattatataattagaagaatatattatacagtcaatataatattatatattattaatttttatcaaaataatcaaaatcttgatataatcctataaattttttgcctatattatcaatataatataataatctaatcaataaattaaatattttcaaaaaattccacaaccaatacactacaatttaataaaatacattttttattatttaaaatggaagagcacacacacaagatgattcatatttggatcaaactttcttcccaaatatattctaaaatcaagagatatcatatatttaataatccaatataatgattatgtatctctacatgtttcagattgaacaaaatatatattttcacaacaattacaatatgcacgcttgatgacactgagaaaaagtatattcacttttagaaaaaaaataatttccacaatataattttaaggcttaatgataaatttaattcttctatttatctcggttcacaaatttagttcgtgtacttttatttaagagtcctccatttttttcattcttgttattttagtttccaacttcaaaattggacatcacatattaagtttttattgaacctcaaaactttcttcatgtcatcaccctaaaaccttgtccctgtcatcttcaaaaccaaatccctttatggcatgcttttcatcctcatctcctttggaagtaacaacagtctccagttcagtttcttcagcttttctaacattatcccatgaaacgtgcgctttactcttaggcatggggaaattcgagagatctgactggagcgcaccccatatgcacacttcaaaaagtccatctggttataggtcaaagttccagttttatctgacaggatagtatctacctgacccaactcttcattcaaatttgatgtccgcgcatcggctggagtcccagtttcttcatcatgcatttgaatgtcttagttgatgaaggttgcctgtaaaacctttacaacctcaatggaaacataaa

SEQ ID NO: 6919 - DNA, 1100 bp, Glycine max
  Soy_ogl_1653 Gm05:32100501..32101600 Cluster 32
aactaataagtatcacaaggatacatacggattaagaaatcaataaatagaatgtttttaatagaattttaaaaggaggtgcattagaaattaggctgaaatatttggaggaacaattttgctgatttatagtgattcaattctgttcatttatacgtaaatcatatctgtgatctcagcaaaaagaagaaattaggctgaagttgtattaataacgcttttttttttcttcataaaacagcctacttttgatacctaaacctgtactatatatattaaagacatttgttaacattttccctaaacaaataaaattcagcaaaaaaaatatagataacacacttgcttcacgggtttcagttagaaagagagaaaacgattttttttaattgtattaataacaccttttcataataacagcccacttttgatacaaaatcactactataattaaagacatttgttaagattgtccctaaacaaataaaaattaacaaaaaatatagataacacacttgcttcaaggagtccagttagaatgagagaaagcgaaattcatttaaatttgtgtctgccagttgtcatattgcaattgcatttgaagtttacatatgactcaacatttatttaaatttgacagtatcaattatttcattagatttaggcacgatcatctagtccatgagaaagtaattctacttttgtatggtcccctgggtccattttgtagttaggtaaccgtcaataacgataatgctttaggtgaaactctaatcagagttctcctgatattatacaatgaagtatgggttcagtgtgagttctaactgttccaagtatactttgcttgccgagtggacaatcgagtggacattttatcggactattgcaagagcaatcacagctcatttgtgtaattaattacataggacaaaataggttttctttccaattcaaatatacatgccccttttttacttaaaatttatagaaatatgattaattgagaaactgggccggggataattattgaaaaatgcatgctcatattgttttaatttttaagtttaattgggttcctcaaatgaaactatatatcc

SEQ ID NO: 6920 - DNA, 1100 bp, Glycine max
  Soy_ogl_2339 Gm07:14808801..14809900 Cluster 32
tttggctttggaaatttattctttaacaaatttatatattatttattattgtaaggaaggacattacactttataaatcagaaacatacattgtattcattagcctttagatgactttacagataaaaaaatataaaattatattcaccagcgtattattggtggttttacacactagaagcaaacatcttaaacaaagacaaactttcactatttggttttacttcaagctaccgctccacaagaccaatttcttttattgccttccccaccaccaattttgtcccttgctggaattgaattttgtcatcattaaacaactatttcctagttataaaaaattgaggttccattgtcttttctttgaaactatataggaggagagtaaagcactttcgtgtacatatcaacattgattgtcacacatatctcttgaacagaatacgataacaatatttgttaagtatataatagcctacactgactatatcgaattgttggagagctatttttattgtagttcccatacctctctaatcgttctgtttcttgtaacttcgttcttgattggagtagatggacgaatttcattgaacaaagaaaattagtgtgatttattcaataaataaataatattgtgatgatattatttattttatacctattgtccaatcccaaataacacctgaattatttaaaaggtaatcgatttttcatgttaataaaatattcagggatagaaaaaagattgaagatttatatataatttctatcttacactaacaatattatcaaattgaccagattttcataagaaaaattcaacaagaaaagaaaattgactaattagtcaaataagcaataagttaattaaaatattttaccatacacattttaaaatgtgaaattgacacaattaaatttaactatcgaaaaataaaattatttccatattatttaaaaaaaaaaatcgaagagaaggctacactctttactatctttttgtctttggaacagagcaactgcaaaaaaagataaagcacaacaagacccgaacactatggtttggtgatggagagaagagactaggctcttataat

SEQ ID NO: 6921 - DNA, 1500 bp, Glycine max
  Soy_ogl_3472 Gm10:40334101..40335600 Cluster 32
aaacttgctttaacaaaacaaattattctgtaacacacctcagcaaattaaaatgacagcaaagtcaacaaagtgaacttctctttgaagttactctaatcgaactccatatggacgtgtctagaacatgttccctagctagttaatcaatgtgtcacgaattttcactttttatatatgttaattaactagtactaaacatgtccaataatgtgtttgactaatgtctacgtcaggaaagcgtttgcaacacacacacacacccctcttctgtttcttctcaaagctagctatatatacctattcccgtccctgctccttaaatatgcttaattagaatgttaatttgatctccatgcaaaactttgagctcatattgagttcctaaacattgttgtatggaggttaggagaaagccatcattttgacctaaatattagtccacaaagttttcatgtcctgcgtgcaaatttcttgaaaagcaaaagacaagaaatagaatagtacaattaaataaccaaaggttataggccatatgtttcccctcttgtctatgttgatttaatgtctgctagacatatttaaaccatttagactcgtgattattggttttagctttagggggcctttatgatacatgcctcgcctaataagttaatctttcagatttgatcaacttttagacattaacttgtcatcaccattaattgatagagtccaagtactgtcctcaccaaagtatgattaaattattttgtaagtttctccacaatcgggacctaacatgtctccaatattgataactctcaaaatctctaatatatagttatataccaagtggtctggtcatgcaacttgaaatgttgtacaaattcttacacgcaagttgaatccactacggccaattagcaattacaatgtttactgacatacatgaaaaattgaatattgtagcaggaacattgcagaagaaagggaaatatcaaggaatctaacatatgagccaaacgtttttctgatcttaatgataggcgtccatcaatgaaaatatataatgggggacccattaggatggtttttgataccttttgttgagggcaaccatgatggagaggtaagttctgtctccttgtttcttgatgcatatctactttgtggcccaagtgctttcacgcttttcatagtgctcaaaaaagtctgaggtagcatccatcatcaccataacactggaccatatataactatagttatcatcgggttatctcaataatactactacttctcaaccatcattattcattcccctcaccgcaccgcatatgtttgtcccttattatatatagtttgaatctaatatcagaacactttcaaatgcaccaaaattctcatatctagtagcccatacttcacatgacctgctttcggtggttttgtttggtctgagaatatgtttgtttcttataagatggagaagagatataagaaagcactgaatatttt

SEQ ID NO: 6922 - DNA, 1000 bp, Glycine max
  Soy_ogl_5657 Gm17:12850501..12851500 Cluster 32
cattttaataaaaagaaagtttaatttgaccaaaactttttgttagttttcggaattgtattgattgacgatgccactgatgacgtcaatgaggtgaggtaagcttcaaatagcaggcacaagtcacatggcctaaatgtcggggaggctttgtcgactgtcgtggaagactgatggcaaaggaaatttaaaaatattgatggattttgaacggggtagaaaagataaattattaattataagattataaaattttgataataattatagatttcaagattataaccaaaataaagcaacaattaattaataaactatatatgttaaattcgatccctaaatataaattttaggggaggcactccaacaatcctatccttttttttttttaattaaaggctataacaaaagtatcagtgacgggtgcaagttgataatcacataagaaaaatttgtgaactttcaaaagaaaagcaccaatgtaaagttataaattaggtctgagatggctgcatgaggagcagtaccccaaggccaaaggaccacttctaaaaaagagagactagaagaatactaaaaaactacattactatatataaattagtatattttgatatttatatattattaatttaaattcattaatattgttatcgcataaaaatataaagttaactgtaatatatttttggtcaattttgtttcaacacaatcttgaataattaaacaatatatgcctaaaaggaaaatttgttcaatggttataagttcttaaacttttcaaagagtgtatgatactttagtaaagaaagcaggtggaaaaaaagatttacctgaaaataaaggtgaaaattaaaccataaaggaagatttgtaaatgaaagcaataaagggaagcgtgaacgtgtgtacgtgaggatagaggaaattgaaattttttaatatttacttgaatttcaaattctctatttttttattaaaatttcttattaaaataata

SEQ ID NO: 6923 - DNA, 1353 bp, Glycine max
  Soy_ogl_4311 Gm13:27736701..27738053 Cluster 32
tttttctttagttcaaacacctttaaatgcatagttgaaacaaaaaataatgacaattattgttttagtttatccgatttaaagcttgcaaacggttagtctaacatacgctaaatccttgatttcatttggggctagagaaacctacaaaggatgaaattttcatttctgtaatttcatgtcgaacttagccttagaccaagttctagatcgaaacacatagttgcccccctcttgtggctccatttacaaattcgatgtgggaaacttatttgaaacgcatagttagccccctcttgtggatgcatttttaaattggaagtggcaacttgtcaaagctcatgtttgtgttggtgatcagcaccaacttgttaactagtgctagtggtaagcaaacttatttggaatataggagtgtataaaaaatcaaatcaaactgatcaatctaaatattaaaactctcactattttgagaggaaaaaaaatcattttttataaaatagttggatcgattcaattcttcaaaaaagcgaatcatatatttgtaatggataaccgtatttaactgaattattttataaaaatagttcggttaatcgaattgtgattataaagtttgatctttttcaaatgacatgcatgtcttttattttggctaatttatatacaggttacgcacgtgcatgtctgtatggaaccatttatattgtcagctcatgggcaaattaataagtgcaatgcattctatttttaagcttgtcagaacttgtttctctcttacctaaaaaaaaagttttatctctgtttatgtctccaactattaggaactgtattcagttaagttgcaattatgagcttatataactctgttacaataagaaaactgaatgtaaactaactatatatctaactagtgttaaaggaactaattacaggttaaagttaagctaaccaactaaatggccaacttaacagaatacagttcctaatgctaataccaacaagaagtaaaattagggaattaaataccttgtcgacataataaaaaaaaaaaggtttgttactatgtcccctattaatataaattaatcaaaccatttttataaaatgtttttaattataagtacttagttaaaaatttaataagactataaggacctagaaattaagtcaacctatatcatatgttacccaaattgatttgaattgtgggggtcgaagtcgaactgataacagttgctaaatgcatcagctatagcctcgatgcagggaaatggcccaactatattatttaaaaccatatatagactatatggccaatatgtttcagattaaaaaatatttcctttctgt

SEQ ID NO: 6924 - DNA, 1100 bp, Glycine max
  Soy_ogl_4408 Gm13:32334701..32335800 Cluster 32
atttcaaatcttctttgataatcttgtgcccatcactgatcactcagaagctggacaactctccacatctgagatatatgataccatatcagcattttgattggcaaggcaaacccgtttgatgttaccacacatcatttagctcaaagaacgtgaaaaggagtgtcatatatagaagcaactcattttattgattaatatggtaagatgattatacaagagagttacatgtctttacaagagtgtattaaaagctataccaactaactaacttataatatgatattccatgggttattaatacacttacatttaatgaggttgctaaaccatttaatgaatttctcattttatgtgacatcttaattataattatcttttgagaatatttatttgatgttaaggaaaaaataatactcactcaaaaactaaagtaggcaggcataccttaaatcatcattatctaaactttgagctcagattcattctactgattctagctagatttattttaaccattctctagctaagatttgatcaactgtttaaattcgtgttttgtataggaattaatcttgatatttggccaggtattgtgtcttttttataaagattttctgtgcgtcataattgtcatgatttttagtttcttatgaccacatcttgatttttgttgatgtatcatatatgtatgcgaagataaagagactaaccgcataaaccgcacttttttattctctttgatctccacaaaggtttaatatgtgatttcttcttttaattaagaattattcttggagaaactatgacgaatttgcatttcaaccctttaactgagactaactaagctaatggttgggctaagtccattcccaatatttatttagatttatgtactagtacgtaggagtataaagacagaaaatatagaggctggcaatctttttagcgaggtaaaattaatcttaagtttatagttatattctaatgatctagtaatgagatagtagtattacaatatcaaaatatacaaggtatatatttcctctaaatatgctagaattcaacataaaaaaggatgacttgattcctaagaatcc

SEQ ID NO: 6925 - DNA, 1000 bp, Glycine max
  Soy_ogl_495 Gm02:11611901..11612900 Cluster 32
aaattcttcaaatatgtgtttatttagtataaaaattaaaattataatatttttgttgtttttgtaaccttttatacattttataattttttcctctttatttatatatgaaatcatgtactactttttaaaaacacataggaacaacgtgaatgaaagcagacgggatcaaaggaaaaactacttcttttttttttttttaaattctttctacttgagaataatgttttatttatcgaactcgcagcactagtatgatgtataactaaataataccaatatgtacctaaattaagtacttatttcttaaaaaaagaaaaaaaatggtacatacctaaaacatatccacaaatatctaatgcatattaaatacaaatacatactcaatacgtgtacgacatgactattgaagaaggattcatactttagacttgaattgctagctagcactcatcttaagaatttaaaatacatgtagtttagtataactgcatcctataacatatcctatttattgtgctctttattgttatagcaccctagctataaggcacgatgtctgaagtgccaatgctgaactcctcattcatttaaacattccttgatatattcgtgcttagtgctaaccatagacttcactacatcccaaccacttgaaccgaaattgttgtcaactgggattttaattagatttgagaagaaaaaaagtaaaaagtaaaataaaaattaggattgtagctaatagtcgctaattgtttgtaactagccttgattagtaagatggaacgagtataacacaaaacacataattttctaaaatattatctgttccaacagaagtggtcatgccacggaatttggacagctagaatagtctaaaagattgttatgaaagcaagcaagttcatccattcaatctccatctatcaacattccattttcagcactgagaaaagggaatgagaattgaaaactattgtcagtcctcgcatcagaacta

SEQ ID NO: 6926 - DNA, 1000 bp, Glycine max
  Soy_ogl_4229 Gm13:23618301..23619300 Cluster 32
tggaagtgtacagagagagttttaatttagttttttcatgattataatttaaagataagatcctatattattcttgttctaagcacaaattaaaagtttaatgatggacttttaaaggagtttaattttgaatggaatgttttcaccctagtcaatctatacgaattacattcttctgaattttggctactatgtgttgaatgagtattttgcattatcacaccagctatattcgtttactgatggtggatgggatgatcggattttcatggattaaactgaaaagaggtttgaggcatacaagcaaacttgtagaaaatttggcttcaaaagggtattttcgcatctggtttggaatccggatgattttgcagtatctagcactggcagttgcatcaggttttgggtgtttatatggacctaaagaaagctttggtgtctatctgtatctgtatctgttagttagcaatatatattttgtatttatctgatgcatgttggagtattttgaaggggtttactttttgggaggctttgtatcagggtagtgttttcttcaattatacttttgtatcctctgtacgttttatttggaacatttcttgtgtgacaattaaattcttttaataaaattttgcctttcaaaaaaaataaaatttttacaagttacatcctgcgaactgaaaaaattacatttatttttagagattgtatattataaaataagagagtgtaatttaatcactcaaaagagaaaagagtattttactcttaagttgaataaattacattctttgtgtggatgcgattctctagaaaaatttagatgaccagcttacatacaaacacacaagctcaatggatatttgtaaatcaggcgtattttctcactccaaatagcctgtgttatgattttcaacaagggcagaacatagtttcattccaaagaatttacaacataaagtcaaattcttttatatgctattacatttaacaaaca

SEQ ID NO: 6927 - DNA, 1200 bp, Glycine max
  Soy_ogl_5745 Gm17:37423301..37424500 Cluster 32
cttccatgttgaggaagctaaaaccattcaggaaaaaatatccaaaacagaaaaattcaggtgtagaaacaagttccaaaaattacctcctatggtttattgaatattaacatacaaaaaatcaatattacatcatcctgaatatttaaatgcatgatactaagcatgctatcttgaaacttcaagatttgtatcattataggttcatgttagtaacaagagaacacaagaatttaagacccacatgaatcaatattcaataagcacagaaattgagaaaataatattatgttctttcagaaagtgaattcattggtgaaagctgttaataagcactaatttggtaagtcattcaccaagaatccatcattaccattcaaaatatattaaatcaaacacaatcttgaatttatgcatgtaggtctcactattcatatcatgtgtatacaaatatctaacacagaaatggcaaatcattgaagactgtgtcagctatattcaaacttctccaacatattgacagtaaaccaaataacatagatattcttattttcagtcatacatacacagacatacaaatcaatgctcttcagctcattgcttgcacaagataagctagcattctatacatagcaaaaccaaagtgatggtaagaaaacttaacactaaagaaaggaccatgaacaatcttaaccatgttgcaagagacaacagatgctaagagaaaaatagggtttaaataaaaaacaaaaacaaaaattatatacatttatgccagaggcagagatcaaagtacaaacttacttacaactttttaaagaaatctgcaaatatcatacaataaaaatactataaaggaatcaatatttagacacttagaaccaaaatccctgaaaaaaatagaagaataaaaagtcaaaaagtaaaaaaaaaaatcgatcaaaaagtcaaataaaagaatcgatcaaaaagtcaagaatatctattcctctcatatagcttgttgggctgccacttgagatcattctcttgtgacttagaagtggatccagtagtgatctggttgggagatccaagtacatctctggattgcgctcccggaactgaaaatagtaattagcaaattcacactgttgtcaagaatatctcttcaaagttttaaattttaatattaatttatgaagtaacgatagaattcaa

SEQ ID NO: 6928 - DNA, 1127 bp, Glycine max
  Soy_ogl_3865 Gm11:17323174..17324300 Cluster 32
gctaaatgttaatttgtacctcattacaactgacacatcatttgtcaactgttaagttaaacggttaacatatgcaacatcgagaattatatcaaaattggggattgaaattgcaaaaaaaatatgtgggagccaaaaatcgtaaatcaggaatgcaatgaggacccaaattaaacaaaaacagagaatatacttagcaaaacaggaggtgcgtttactggttggtaatctaagtccagcctgatggaccggcccaaacagcccacaatttgctccccttttttttttgttggaacttaactttaacttgatgtgtaactcgaaattctacatgttatccaaattttctgttttttctttctgtgtgtgtgagaaagaatggcttctgttatattataggtcagaatcaaaactaaagaaggaataaattaattccagtataattttatctagatatgaattgagggaaggaaaattctgtgttggtttaggtttatttagtgaactttgcttgtgataacttgttatttaatttgttattacaagaaaatctaaaactacttttgtgcagaagttccatgaacttgcttgcttttgccaaacagtgtttacttattgtttttgtcctatgatttagagtcttagagagacaattgacttgtgtaaattaatttttaatttttaggtccctgtactttttgaaaaaaattaaaatggtttctgatagttttctatggaactttattcacaaaagctgttttattcattattttatataatgttatataatgagaaagctattgaggtttatgagattcctggctagtggcaattgaactgctactatatgtttttaacaagcctaataaaaaaaactcattatgtttatatctaatgttgcattttttagagatgagtcaactaaagttaaaagctcttgtcatgagtcaactaatgttgggttttatagactgtagattctgagatttctaaccagaattcttcttcttctcttcactaaattattattattgctgggcaaactgagtattttaagatgcatgtatgtatatttaaagaatcttagattttgaatataaattaagttcttgctatcatgtgcagtc

SEQ ID NO: 6929 - DNA, 1000 bp, Glycine max
  Soy_ogl_5106 Gm15:42308001..42309000 Cluster 32
gttgaagagaaagcataaataaattcacagtgtaaaccctagatatactgagtttcaaagtagctagcatgtgttccttcaaaagattctctttctttttcctggtccctcatttcttattaatttgttgagattgtcaatttttgatatatatatatatataatggttttataattcttgtgaatttcccgatttggcaaaatatagtgaattgggccaacttatatagtcaaaacatatatgaaatgaaaacatacatttaataccataattagtttttggtatgtacgttatgatttattttcttcctttgtgttttggccttgtttagtttagccctgcatgatttaagttgcgaggagcgactatatgcctcagtagctttaataagttgagtaatttacattcccttgtcttctccacttatggaatttgatttatccgtctccagttcaataatttgttaagaggctgtttagagaggggctaaaagtaatatttaaaaatggaggattaccaggtgtaataagtctaaatcttaggggatcaataatttattctattttttattattcaacaccagtgagtggttattaagaaaatagttgttattattaattttaagtgatcaatatagtcattgtggtttcatcaaagataattttaactaatatacgttccaaatgatttattttctctttaattaaaatttaaactatccttttaaataatttaaggcatgttgtgtattaccaaaaaaattagatcggttatatttataaccaatctaaaaatttcttgaacaatgtacaccacattgtatattgaaaaaattaaattgtattgcatataaaaaaaaacattttagacatgtttataactgacctaataaattaactttttagatcaaccgtaccaataaaggatccaaaaatttatttttagattgattcagtaactaaaaaaattgattataaaagttaattttttagattgatt

SEQ ID NO: 6930 - DNA, 1200 bp, Glycine max
  Soy_ogl_3258 Gm09:42944101..42945300 Cluster 32
tacttttgactaaggtctcaggtgaacttcatacatgaaaaatcaaaataggggaatgccagtgtgggccaaggcaagctaaaccactacacattatataggttcattcatttccttcacgaaaagctcatcaaaatggggaaactaattacatacatgaaaaacaagaagaagaataaaaataattatgtcaagaatgggattcgaacccatgccctttcggaccagtacctgaaactggcgccttagaccaactcggccatcttgactttgttatttcccgttgtaagtaaaccgaacataaatatgaaaaaactcagaactcaactccaaaactatttttattataggtcttattagaggaagctattacaagatgtattttatttgctttttttttggaataaaaattaacttgaaaaaaatattaatggacagtgagaatatttatttatgatataagaacattttttctattaatctttttatgctataattaataaaacaatcttttctcctaacatttttacttttagttctcgctgaaggaacttagtatatgattgtattttttctgttttggatgttgtgagtaatgaagccgagaaaaaatttcactggtaatgaagccgtgtatatgaaggatcttagtacttctatatttttccttttcatttttaatcctttgttctttttattacttaaaattagtccttctattttttttttcttttcatttttagtccttgtccttttcattactcaaaatttgttcatatgagattgaatttttgtccttttcttttaccaatattttgggattaatattgagtaataaaaataaacgagaactaaaaatgactaaaattagtcatttgaatttcgaaagagattaaaagtagaccaaaatcttaagaaatattaaaaattaaaatctgaaataattgaggtacaacaacttatttaaccattcagaatatctaagtttggttgaaatagctaattaagcacatagatattgaataatatatgttttggttttagattgggctgaaggcccaatttatgtaataaatcactttggttcaatgtgtaaaattctctaaagtacattgatcgcgatccaacacttcactgagtacatgataattctagaatatatccacagttaatcatatctcaatttagagcattctgtca

SEQ ID NO: 6931 - DNA, 1198 bp, Glycine max
  Soy_ogl_2344 Gm07:15364703..15365900 Cluster 32
ttggtgcactggtaaagcagaatgtgttgaggttggtaacatttgtaatttgtaaacttaaagctggtccaggatcttaagacaaccacttttttgtaaatatgtagtcattttcagttgcatttggaaaatattgcacatacattgtgttaagtaaaatctatgacaacaaatatgattaggaaaggatacaacttatgggtttttattaggcccaaaatatgtggctgtatatgttgaataatgagtagagtagttcgtttagatagattactggccagtgccacggatgaggaacatacataactagaagttagtaaacttacttaggagtcactttccgcatcaattattggaatattgaaggagatgtcatagcctgtctttgtggttgtgggattcgatctcaacaaattccattgtcatactcatacataccatgtgcactctattaaatgccctttggcacttatctcctctcatatggtagaggggagcttttaataatgaatttactttcgtaggatatataatcatttaaagtgttcctttaattaattagtggttggtttaagtagtacatatatgattttacttaaataaatcttgtatatgtagaaatctcagttaggagatctaattcttccatattgtgaatgttcacatcttgaacaagaaaaaaagtagttttttctttaacatgcattcaaaacagtattttaatttaacataaattgaatagtaattttaaataattattcaatcttaatagatgttatttcttcatggttaaattattgtttaagtccttataatcttaaataaattcttacttgccaacaaccgttaagactttaatatattttattaaattacataaacatattaaaagcataaataaactataggatctaatggataaataacgattaattaagtgtctgtttcatttgagtttttctttttctttaagtagttaaaaaactagcataatactctgtctttacacaggtgacttgactatttttaaatataaataatataatacatatataatttatcaaggtcattgccattaaagaaaccaatatttatgtgatggatatatttttacaaaagtttaaactatattttttatgttcagtaagaacacaacaataagaaaaaaaatttgaatattaaaaaacatgttttttat

SEQ ID NO: 6932 - DNA, 1110 bp, Glycine max
  Soy_ogl_4014 Gm12:7740791..7741900 Cluster 32
ttagttaaggaaaaagaccggaataagaatgtaattctgtgttttatttatacattaaagctgtatatatagatatgtttcacattgctgcaaccaatcattggccagccgtacaagtgctaacggagttctggtaaaaaaatcctaatcggaggtcccataacacattcgtacaattatagaataattccttgagatagtaaaatttattttaaaggagatatatctcaacaaatatttttcatatccgcaaatatgagaattatacttctgatcacatatctaaagaacaattatgtgtcaaccatgttaatgttagtggtttcattctcatctcgcttcattttaatattacttttaaatcttgcagtttgtaataatctaattccgggtcctagttttttcttttttaataatccaacagtgtcgggaattcattgtaaaaaaaaaaaaaaatcttctgctcccagccctttaacactaatctaatatgatttatatcgatcatttttaaagacaccaaatgttattttattcgacttactaaaattgattggatatatattaacattgtttaactatagctattagtgcaattatcttctacttactaataataaaaattcaggactcaactcatataagttgttacattatataaactatttaattaacaacaacaattgatacacatgataatgacaattgatacacatgataatgatttgtgtcttttatctgactgataaaaaataactaatatttggatataaaataaattgggagaaaaatatccgacgagtaaacaaattgactagattctagatatgataagcgtaggagattatttatgaacaagggatatctgctataacaaatcaaagaagctcataataatttcttcactttcgattgcaaataaagaacttttgtttctcagttttcaaaactcgtagcagtagaagaagtatagtatagcagtggaggacacctcagagtccactttttgtcttacactgtttctgcttttttcgcactttagcatgttcaatctgtggtcactatggagtctgaacgcactttgtatttaaaaatagaattgaaaattta

SEQ ID NO: 6933 - DNA, 1100 bp, Glycine max
  Soy_ogl_4398 Gm13:31909101..31910200 Cluster 32
aaataaattttatctgaaatgtcattcttttttattaatcaaaccaatagtaatttaaaaaagtttcatgtaattgaattaaacatatcatatgcaaatattggatgacaatgagcactcctttattttctgtatgggccttgttaggaacatggatgataaacagcatatgcaaaatgacaacgatggatgattaagccaaaggaaaaagttaggtacaagatgcatgtgagtctcacccattattgttttaaagactgaactactattgttagcaaaatatgtaatgtaacaaaaaaaaggaactacttagatggcaagatccaatacttttgggacatatttgacgatctaacaaaaacatgagctacttagatggcaagatccaatacttttaggacacatttgacggtgtaacaactacaacttgtggaccatgattttggtgatctactttgattattgaaatttaatgcaacttatcttcctactcgaatctgaaatcttgtgtaatcataagaaaactgaaatcttaggattgcttccttgtaattgaaaggaaacatcatccagtggcaacataactttgaataggtgtcagcgtcctcaactaagacctaggataagtttcatagttccatgtaaccaaaaagaattggttaatgacaactaggctgacagaaatgaactaagtaccccatatggaagaaatctttttgtcacaagccttcaccactaatgacattgcaaggctttcgggccatattgtatttatggtcaatggcgatgcaaaagttctcacgttccctaaacttataaatgtcgtcacgctctcccagattgcaacttaaatttaagtgtatattttttccgttccaggacgtttaaggttatgacacatgtactaagaaatgtaattaattttttgaatttcataaaaaatattataccacttcctaatataccatttatctctctaataactactcatttactcatattactttaatttacagtactctgattaagtgtaacagattcccataataaataataaatgttcatgttacaccctttcatcttccgtacttcaacaagaa

SEQ ID NO: 6934 - DNA, 1114 bp, Glycine max
  Soy_ogl_1960 Gm06:15502087..15503200 Cluster 32
agaatttgactgctctttttgaataaaaaaataatctaaattgattcctttaatattaatataacattataaagtaaatatctaattattatcggcttatgttttaactacaatatataattacaattgattaaatcaataagttataaatcattaacttttatcagtggaataacttatccggttgtaaaaagaataaaccatcattggtctcaagattaattcgttgtaaaaacattactaaaaacatatgcacaaaaagaaaatttttggtaagatagactcatcagttgccgccccttacaactctagttagttgtgacaaatataatggtcggtaaggtcaagttcctaaccaccaggtgattaagacttgatgatattatcatatatcaaaatcaacactctaaaatggaactttaggaacgacttaattatatgcgaattaacaaaaatcattgtaaaaaaattaattaattttatggaatatatatgtacgtagttactttgaggaatattggtatctgtttgacatgttcaattatcatccagagtgttcgggatcactagctagtaatcattatatatgaaccttctctcaaatcccccatttatattaattaaccttttagttcaatagtgtcctagtggcgaaagcatgaattagttcttaattactggcatctgcaaccatatataggacaagggttcaggtatagaagggtcccggccgaggttcccctttcaacttttcaggtaccatcctcaagccattattgaaaagcagaaaagatgcaggtgtatctgattgaacttcttaacgcttattattaagtgttttaggttgagatgaaagatgtagggcagccaccttagacaaatactatttcacacgtacctgagtttttttttttcttttcaaagaaaaaagtcaaattctaatataaaaaatatataataactcatgtattgatgtaaaaaatttataataactcacgtataatattttcttaataaagatctcgctttaaattccactattttaaatgcatgaatcttgtagatcttaagatttgtcctaaataaactctcaagatctaattttgaatttttc

SEQ ID NO: 6935 - DNA, 1400 bp, Glycine max
  Soy_ogl_7 Gm05:32631801..32633200 Cluster 32
ttctttaggtgtgaaacatgatcaattgatgttatatatatatataggtataaaatttcacacatagtaatataacatagtaattccttagtcatgattcaagacataatcaagtcaatttcaaatatgaagatagaatttcctaaagctatttttataaatttgtaactaaaagcacttgatatcatgaatagcctaaaccaaatttgcacaaggatgtgtataacaagttttaataaatagccgatgtcgaaaatattttcaacaccaggattgttcttcccattatgggacaaatggatgtaaaaaacaatcccaatcatataaattgttctcatactatacctaatttaggggataaagtctacacctagatactacttttactgttccatcgttccgtacagctctggcatatctcgtgttaattgttggcgcatcattctcatagttactttgcaatttcttttcctgttacaaatcatgctgcatcacatgtgtggctgcataatctttattacgtacaaggctttgttgtggtcacgtacgtgggcattcagctaactttctagctggtgctgcaaaagtcttttataggagataaatgggttagctgtaaaattcactaggtgtactgagtgcaattaggtgttggtttaaacgagcttgttgaagaaggggatgtgttaccttgttaagtattccaatctttgatgcttttgttactttgcttttgatacttgattacttgtactcaatttcatttataaactcatttgcttaattatgtcagacaggtgattttttttttaacatttcaattaattttgacaaaactttaaaatcattggataagtcaaatagtcaatccacttgcacaaacaagattccacaataataccaacctattttaacaaaacaaaaaaaaaacaccaattacaaacttgtgaattataattttgttctcttttagttaactaagtgcaaacagtatatcacattaaaaaccaattccagcaaagaaaaagaatctctagccatatggaaactaggcaaaatttaagaacggactcaaggcggtgaaatttgcacatgttcacaaagtaattgtatttgtaaggtgaaacggttggatggaaatatgtgttttaactgattaatgagataaagtgtatatttggatcgattagcattcatgatccatgtttgatcaaattttcacctcaacatacaccaaaaacaaataagttattatttatgtgattctcatttgaattatatgtggatgtgaataaaaaaaaaacattaaaaatattaataatttgatcttcgtcaaatgattatgaattgttgaatgcgtggaaaattggaaaattgaatgcaagaatctggatcccaaa

SEQ ID NO: 6936 - DNA, 1100 bp, Glycine max
  Soy_ogl_1866 Gm06:8799201..8800300 Cluster 32
ttttctcttcatgggtttctgctataacctccatgtttttgtttcttttttctttttaattaaaaaaaactaggtattatttaacattttgggttccaaatatcattttctatatatcagtaacgcttttgattctattcactggcctcaagtggagtttgactttttgaccattaactttaaaacttttatctaaattagagtcaaaaaataatttgtctttaactgaagtgtaagacaaattgtcctgacgcaaaatttcttttcaaaagggatctaccatggcattgcttagttctttgcacaagcacgcaatctcagaataataaagtatacgtatagtgacaaagatttagggttggaacccagttgtgttggtcaataaagtgaggaaactatcgtacaaaaagatctaatatagtaacccatttctccatgttgacatggtatagtaactcttgcatttgaagatatcgaagaggaacccaatgtcgatgtcgatggccaacatggtgaggtaactggtgcattcttggaatgggaacccaatactatttgtcattaagtgacaagcttcgaaggttatcttttgttatggttgaagtttttctggtaactgctgttgtgcagatcaacatggtgtatgaccgaatcatcactttgtaagcttatcattccttgcacgtgcttggggcatttcatgtaactgctagaatgaatgttcaagtttgtgccgggaaacatgttgtaggaccaaatcaatctctaatattgtagcatgaatgcttgttgttttctatcatttgacataattgcgacaacggaaatatttatgggcattacttgaatttttttataagtcagtttatattattgctaaaataagcataaggaaattttttgttgttgtgaaaaacagtggaagccactgtctatatcaattgaaaccacgaaggaaggtcaaaatttgcatatctgctttgagagacaaagctattaaataaggaacaaaataaaaaatctaccaggtccttggagacccaacccaaactttgacagtttatccgctacttggtttccttcacggaaaatatttttcc

SEQ ID NO: 6937 - DNA, 1012 bp, Glycine max
  Soy_ogl_379 Gm02:4680201..4681212 Cluster 32
ttttcatccttaactaattgtagatttaatgtagtttatacttttaagctattggtgattaaatgttatcacaaaacacaattttttttataaaatatcttcgtacttaaattgacacatattggtggctaaaaaactctacaaaacacaaaacccggaacaaaagaaataactctcaattaacaatttttgaagtggaatgggaatagagaatgaggctgtggctgagtacaccaactatgctttggcatgaactaacaacaaacaagacgcttccgtcgctactgcaaaggatgacagagaggatacaatacaaaaaaattaatgagcatgttatgatttaggagagtttgaatgttttcattttccaccaatttccttcaaagtggtatcaagaacatatataaatttttaagacacctatttttctttttccaattcttaaactcataaaagatgtttgcgtaaaggcaattcagaaggtatggtagatgactgagaaggaatatgataaatctgataatgaaaaggatttcaaccaaacccatcagaattcttcgcaaaacaattgatcacaaattagaccaatatgcttttagcattatcgggcaatattacatggtgcaatgtttcagggggaagagggtgaatataatgtttttactaaaatgttttcaaatgcgtacatagataaggccaagaagatgcaatttcatattgaaaaaataagttcgaattcctatacatgagtcattaattagtacatttccgtccatgattattatacacaagtattggcaattctaaataaataccgcaatgtgatatgaatcttgaagatgtgatatatttttgtatggaaaaaaaatattgttctttggattttaacaatgctattttggccatgatttattttgaaaaattctctatttatgaattgtaataatcttcacaatagttcaagcactcgagacaaagattcctacgtcaaatttaaacaaggctggccgtt

SEQ ID NO: 6938 - DNA, 1000 bp, Glycine max
  Soy_ogl_3792 Gm11:8018901..8019900 Cluster 32
ttctattattgggtccttagaggacaacaagctggttggagtagacatgggaccattaaaggtaacggggatgttgcattccatctggagttaaatatgacgagctggggaatttgctgtagggatgattcgggttgcatcctaagggctccagatttttctgaacttccctccatcattagagagtctaaatatatactctcccttaatccaaactattatgtagagcttgtcaatgcccttcccatggtagcaacatgatatatgcaagcctgagagttttttttttatcagatttcgatgtgtatttacaattgcatcattaatgaaatgagttgagttttttactgtaaaaaaaaaaaaaaagagtaaattctattccataaaagatatttatagagaaaagacaaaatattaaataaccataagaattaagtttaaaaacttatatataaatcatagtttaaatctctagtgataaaggagcgtttatgtctagtgctcaactggacaccaaacacaattgctttctgatactcataaaaagacttatgaaattaaaataaaattacaaatatcaatttattttttgtcgagtaatgatttttcattaaagaaacataggcaactacatcatgcgatcactaaacgtaggagattttattatcattgacatccattaatattcgagttttttttattcgtaaaaataaaaataatattagaaaatttaaaacaccaacacatcatgctcaaagaagagttaaaccccttaatatatattcaaatataattcttgtacagtgaaatacacattatttaatatgataaataattttttgtctcaaaaaataattgtacaatttattacattaacttgacagatatcttttgaatttagtgtaataaaataaaatttaaaacaagtttaatattctcataatgccacaaatcatatttcttcccaacccaagaaggttcatagttccgacaagattta

SEQ ID NO: 6939 - DNA, 1021 bp, Glycine max
  Soy_ogl_4211 Gm13:22898580..22899600 Cluster 32
tatcttataagttaacttatttttcataagttactaaaataaacttgtatactaaacaatcttattttgttcaaaggagcttataatctattcaaaggaacttataagttcctcaaaagccttacaagtgaagttttaatttggtgatttttaaatatcatgtatatcaatcttttaaaaactaataaaaaattgtaaaattactttatccattgagttatttattatttttcaatccttgtggagaaatcttaaccaataagaataatttaataaaattattctatttattaaattagtacttgtttttttttaatgttttatgttatacttattgtgacatagatggactaaggttgttatatatgatacgattgacttaatatattttaatttgtatatcccactaaatgattcttcaatcattctattttctttttgtggtgagtgtttggacaataagatatcagatcagacagacacaatggagttgagaaatggagtgtttcgttcacatatttgttggtcacaaaatggcgtttacttgataattgacatgataattttctccaaccttctttgtctttggacgtcattttctatgaaccacctttagttattctttgatttggtcattggataacttctctgtcagtgtgaaaaatgttatcttctctcattattgatgaacaacactgtgtactttaactttgggtaatttttaaaatcactttcgaacataaaattttggacctcaaattgatttcataaattaattttggggtccaaaactagtttcaaaatgacttttgaacttaaaactttggacctaaaactgatatttaaatttatcttaaaataacactttgtatctttcatccttataaatacgtttgaaattctaaaaagtacacagaagaaatatactaaatacactttgaatatagatggagaccaaggaaagcctttcaaggaaaaaaaccaagagtagcttaggagaggaagaatctaactgggtaag

SEQ ID NO: 6940 - DNA, 1000 bp, Glycine max
  Soy_ogl_1356 Gm04:42974401..42975400 Cluster 32
agtagaaattttttaaacgatgtttttttgacgtatctttgtaatataaatcttatggtcaaattgtacatcataaaatattgacatttttcaatagatattttttcatatcataattgaatctttaatcatatacttaagttataaagttatctattaatcacatgtcacaccatgattaaagcatatgctttttataattggacaacaaaaatactattatatatttcttatataaaagatggaaggtagtataatatttaaatttctcaagctagggagtgcaaaaggtattttagtaaactaaaaatagttttgatgaaaaatttaaaattgggtaatataaggtaaatgtctatcttgacacaagaggaggaagtgacttaatatatgcatttcttaagggataatagtgtaaatgatattttggtaataatttttttaacgaaaactactaatactttagtgaaaatcttaaaagtggaataaaattatcatatatcacttttttttcttacagaaatatactcatttttctacaggaaaatactcgcatttgttagaagaaggaagtgtatagttttgaaagtttgaccgtgcgtagctgatattgtgatccaacaaagtaaatcttggaattaatatggatattctgaatcaaatctttcatcctgatgacatctctgttgttattcacactcttgttgcggctgtgaattttgaggacaagcttattgggtagaatcgaatgatggaatctacactgtcaaaagcgcttatcataagatcatgtcagatttggtccatcaagataacctgacggtcaatggggattggaatttgttgtggcaaagttagctccaagagtcaagctgatgttatggagggctaccttctagaagcaacatggggatgcgaggagtccaatgtcctttaatttgcacattctgtgaaacaaatgtagaaacatgtcatattttactgacttcccattgaattt

SEQ ID NO: 6941 - DNA, 1100 bp, Glycine max
  Soy_ogl_2649 Gm08:13169601..13170700 Cluster 32
tttgctagaatgttagcctcttggttagcctcgtgatggacgtacgtaacaccatctaatatgctctcgatgctgtgaattatgaatagacttgattaagcctaactttttaatatgattatctcatagctacgtttatgttactataatataatttacttacatataaaaatactactgcagaaataaaacccttggagcactattaagaacatttttatccatgtattattgctttattaatccacacattgacttgaatattaaagtatttgtgcagatattcacattatttttagagaactcatgaaatatcattaccttttaacaggaagatctagttgataaaaagaaagattaattgaattttttaacttcaattttttactttttgaagaattttgctcctgacaaattatttcagcttattgtacctcccactttttaaaatatcgtgaattttacctttcgtcgtacctttattaaattccagacatcgctaacactttctaatgattttaaccgtcactattatgaagttttatatttttttttcttttccctccctagatgtgcaagtataatacttcttttctttatccacgtacaagtccaacaacctaaacattttctttggcattttcttgcactttgccacgatctctctgacaatctgaacagtgacatcgtgccttctcacaggactctgtgatctgaacagtgacattgtgcacatgaaatagagtgtcaatgatgattatttcgacaatattcaaccaacacttgatcttatcgtctcaagcgcctcccagtccatcttctgagcctgagagaaactaactctctccactctaaagtggtgtacagtgcctcaccacttagaagaaaacaacaagtccttttgttaaatatatgattaaagttgttttcagtttgactaatttttattaatttcaacaagtctttcaaaatttcaaatttatgaattatcatgctatttaattctcaacctagtgtcactcacactccataaagatgtcattttatttggcacattttcatcaaacaccttgtcatcattcttctcaagaaaaaaaaaa

SEQ ID NO: 6942 - DNA, 1100 bp, Glycine max
  Soy_ogl_2741 Gm08:17175301..17176400 Cluster 32
gtcgaaatagggataaactgatcaaaattacactgacataacaaagttttaatttgtggttgatgtttaattactataaataatcaataactatttattataattggtgataattttatggtttcttagtaaatctatgatcaaactacgaaccttaccattttattttattttgattccaaaccttttactcgtgttacgtgaacaaggccaacaggttatcgtaaggtcataaccttttacattattatactccagaaattagaacgtgaacgcctaaaattcctacaccatacgaataattagaataataaatcagtaaactcatttcattatttaaactaatatcataatgacggtattctgttatatgtcagtgtaaactaatatcataataatgtaaaagaaaaaaaactaatgtcatagtaaactccgtctttggataaaaaaataaacaagaaactccgtctatcataatagtcaaacataaaaacaatattattttaattttttaagattaaacattattagaatagtcaagaaacgccgaaaatgtcaagttaccatcttgagccgaattttcggattcacggctcgtaagtcgtaaggctatgtgccctaaacgatacacctactatctagggacttctaacaaataaattcttaatttgcagataatgttaatgtaaatggccattcgttgttaccatgcattgttcactgaataatgtttacgtttgtttcgttcaacaaataatgttttatttcattcgagacaaatagcttgcattgtactcgtactggtaattaagaatgagttttgttaattagtgcaaggaaaaatatattttgagcatcatatgagactataaaaaaatcataaataatattattttatgtattttaatattttttttcttttaattctttaaccaatgcattaaacatactaattaacatttctcattaattccttccttaaaaatatatttttcattaagaataatttaatgtgcatttggttgaagggacaataattagacatgacactaaaatatgtggatactctctgacaagtcttgagtttgatagggaaaatt

SEQ ID NO: 6943 - DNA, 1000 bp, Glycine max
  Soy_ogl_18 Gm12:35961401..35962400 Cluster 32
atctacttagttcaggtactgcattgtctgaaacatacttgcccaaacccgtttgttgttcattttgcaaatttccttactgaaatgataataaatcgaatattgggactgatttctattgttatgatcatgggtcccatgtactggatatgttttgatttgttactaattaataactaaaatgagttggaattcccttgaaatacggaatcttgtgattttttattggctgtacatccctaaggatcttattttgagtccataaactgtcactgttggaatttattggcatgaaaatatgaatgagctgctctatgatacttgaactgcatcttgtgttttgaattgttcacgagatatttttgaactttatatgtcttgattccattttgtctgatttctgttattgactgttactggattaagtctttgatgcatcagattgcttgaaagtttattgtaggttgcatatgcatccactttcacttgattgagaattctatatgcatctaattagttcaggtactgatttgtccgaagcatatatgcccaaatcatttgttgttcattttgcacattacttgactaaaatgagtgcacagaatattgggcctgatttctattgttatgattaagtgtcccccatgaactggatatgttctgatttgttaataactaaactgagctgaataatttggatacgcattgaatcttgtgattttttatttgttgcacagtcctatttgactgcatagattgccaatattggaacttattggctgccttggatagaattcgatagttttgatctatattggctatgaaactatgaatgaatttgtctgagatacataaactgtaatttggcttttttggtagcttaacttaattatattactccaaaaaaagcataattatattactctatacgacaacatcatttgcattaattataccaatgtgatttgttaggtagtctaagaaatacttttaattttca

SEQ ID NO: 6944 - DNA, 1000 bp, Glycine max
  Soy_ogl_4384 Gm13:31271101..31272100 Cluster 32
tttactgcaaattaatcagcaatcattatgccttgtccttgatctatttaagggcatctaattttcctgcagcctagctgaactattggcttccaagaggaatctttttgcttgcagcaaattaaggaaatcacaattattctcagcacttttgttcctattttgagcacgatgctcggtggcatttcatttgcattggttttatttaatcaaattccaattggtatcagacttcacaaatttctttgtttgttgttttatgtatttttttttaaagagcgatagaatttttattagtaagagaagtacaagttgtactactcctacaaaatccagcaaagtacaaagcaagacaattaaccaaaatggcctgatacattaacatgcaaacacgaagacagagactatacaaccaagaggatctagctgaacagaatgtgtatctgttgtagattttctgttaacgtattcaatttctacctaataaaaaaaaagacaggatatacaaaacccctcctcccttttaaccactttcaagaagtaatatatttacagactcaacagcatcatcctttatattaacatgtttcccctcaaacacccttctattctgagccttcccacaaagtccacaccactatccttccccatccacgatgcaagatcataaattgatgaaactgggaaataaccccagtcatttcaatgacattgaaaaaaacacaaatgttttggggattcaggtttctccttgacacccaacacaccacagattattatcatctaatatgtctcttttacacaaattttgctttatagtatttctgtcctgtaaaaccatatattcatgcaaaaaaataaccacctttaaaggggactattttattccaaacttttcctcacccaaaaccccttcaaaattagctatttcattcccctttccatgagaactttatatcttgggtcaattagactaacccacaaacagcagttactttct

SEQ ID NO: 6945 - DNA, 1077 bp, Glycine max
  Soy_ogl_5923 Gm18:3296801..3297877 Cluster 32
ctttctctcttttttataaatagaaaaattcaaaagaatataggattttctctcaagtaattaattttttttagtcagttgagaatttaagacatcgcagatactcgttaattagcagtgcgtcaaataacttcaaatatttcgaaatcaaacattgaagacacacatatggaatgatttagatactatgcaaacacaaattcacgtacattgcagatactaattgcaaatattcaagtggtgcggctaggccatatcatgtttgtttttttctttcggcttttgccccatttgcaatcagaataaaccagagatcatactatgaagtatgaacttcacgacgcctggttcttacacgaaaaaaaaatgcatggtggattttgactgggaaaaggttaaattcttatttagcaacgctttcaatattggtaagataccaagcacgatagcgtaagactaaaacggacgtagattctctacggcctacagcctctacagcagcatctcaacctttcataattaaatatgtaaatatatttttttactcttacttttaataactattagattttgtttctgtcgttaaattgtacctcggagaaaagagaccttacccataaacattaagtgtgaaagtgtagtctgtcttgcattttaggtctaatataagttatgtaggaacatgatatttgaattgggtcgtttgagtcaatagccttaaatacattcacccaataaaaactgaagtttaaggatagcataatacgctattcttggcccagtaaaattttaaaaaactacttaacaagaagcccagccttgtattttaaggactcctagatctggtatggtggcctttttagtcttttatagtgttttaggggagttatatttgtactccttttttctcttcacaccattccactttttttatataattccataaaattagattttgcaatgtatttttttgggtacttggattttgaaatgtatgaacggagattaattttcaggaaataaaaaagaagataagtgtaaagagataaaaggaaaatataaaagaatgggccagta

SEQ ID NO: 6946 - DNA, 1105 bp, Glycine max
  Soy_ogl_4334 Gm13:28911101..28912205 Cluster 32
aatttaggaaaagagaaagaaaaagagaaaatatagacaaaataaataaataaaatcttaatcaagtattaaaaaataaaacttatttatggaaaatttagtcccacaaactaaacaatacaattataaccctttttttaataacattttaatctagaggtcacatagtcatgtatataaagataacaaatacttttttaacatttataaattaaaattgatttttttatctttcaagaataaaattgtgaaacgccaaaatgatatttaccccgtattccagcattagaggccactggcgtacattgtattgaaactacagatgatgcgcaatcactttgtggtgatgaaagattcaaattttagttacatgtagaactagacatttttggatttaagcctgcaggcaacccgtttaacttgcaatccgcacaatacatatgctttaaaattgttagaccatttaagatgtgggctttatagcccgtcttgtttcccccgcgggttaaagaggttttgtccgtagtccttttatttttggattaaggagttctactattcagacaaaccaaagagaacctcactcacttcattttctgaatacacacttctgtaggtttgagacttcccaaaccaaaaacaactacctatattgagttttataacaaaaagagcagtaatgagaatattattggaattgcaatttcattgccaacgttaaggagatgatgttggtttttcaataggaactcaaggtacattttattgtccctaccaatgggttttgacatttctagatagtgttttattttcaagttcatagctatattttttatgttcaaaatgccttttattactctcagtttttgtttacgattgcatccacctggtaaaaaatttaaatttaggatttttttttttatatatacgtgatctacgggtcgaccaattatgattatgcaggacggttgcggactcccttagatgaggtttgtttattttgcgggctttacttgtatacctaactctagtttcaggatgaaaaattacatttcagtgatgattcacttgtcacattaaatctacattgatggaatgataattt

SEQ ID NO: 6947 - DNA, 1100 bp, Glycine max
  Soy_ogl_4757 Gm14:40730001..40731100 Cluster 32
atgttctctctttttgttagttatttttattttaaacctgttttcttatggaggacccgttatcctccaaattcatagtaactttttgctctccaacttgatgattttattcttttaaaaaaaggaaagaagaaaacaacaagcagttttaattccaaaattttgtaacaattactaaatcttaattaaactagccagaaggtaacacaaatattatcattcaccactcacctcattgtaagcctatggttatataatcatcaatcatttatcagttcagctgcagttttaataaagcaaaagaatcaattcatataaacatcaagtcattagatgaagttccatttataagtttggtctttagaacaattacacccgaatgagaaaatgccaaagaaagaacttaccacaatcaaatgtaagcataggcttcaattttatttcttcctcccgtgcaacacacatacacacaacaaaagaggataagtagataattttaatttaactgtgttaaacacttggcgttcacacaagaaccaattatttattaattacaacacaaatataactaaaggcatcaaaatcattaaattgaataaagtctggttaccaacttccagatattttcaataaaatatgaattgttcacaaacaaaaaagaaaaaagcaaagaattagtgagtaccatatatatatgagtttcattgtccagcctgtcaatagtgtcaaatgtgtgtcaagaacagaatatcataggcgaatagatgcaattgcaagaggatatagaatagaactaagttccacttaggagttgcgaatagttttgctcaaagttgaggctgatgtgaatgttttcccatcaatgcatcactacaaactgactcaaaaatagtaaaacttagaaaaattccaatcataaggcctactgagttgtaaaaggatacaaaatataggtaggtttaaatttgcgggtcctttggcataaaatatgaaaggtttgaattttgcatgaaagctagattcttaacaagcttgagattaggtgataataatagtttaaaaactttatgccaaataatgttgtacaaggcttggatttt

SEQ ID NO: 6948 - DNA, 1019 bp, Glycine max
  Soy_ogl_2097 Gm06:46660682..46661700 Cluster 32
ccattaaactgttaatgagtattcgctcttatgagaaattaatacaccaaaaaaaaaaactatcattttgcacatgtgcaccgcgccgtacagaataactgaataaggaaaataaatagctttttaattttttttaaaattatatacatttagttttaaatgataataaatatagttacagataaaaattactactatttatcgtcaaaattcacaacctaatgactttgaattttattgaacggaaagtgttacaataagacattttaaaaaaaaaaataaagaatctaattcaagttttaaaaaattaaagaacttgattaaaaattgtgaattaatatataattggtagaagggaaagaaaagagataataaaaattaaattaaaataaagaatagaagtatggatcctacaaaattttacttttcatttcatttttttttcactctctttcgtctctaggaagtggactattaagaagttgttcggatggctaaatgaatatgctataaaaaaaaatgtaagggtggagttatcactgcattagttacattatcttttgtttctataataacagttatattatgcttctaatatcttctgcttcatcgaacgtttgtaattagaaccatagtttttgccgtaattctaactaataattagttctttgtctaataccaatgccactaagaaacaaaatgtagtgtgaaagtgaactgtttcaattttctttttgtgccaccaaacttcataaacacacactttccgtgaattagccagagaaggcaaaaagaccacacacaaatatcaaggacaaacatgaaatccctgtatgctagaagacagagggaagtagaaacaaattcaagtttatcttgctggaaggaagaagataaaagactaagaggaattcagaaagggatctgagaggtgaactactccaagacatgcagcaccagcaggggcatatgcatgtcagcaacactctgcaaatataacaaccaaagttttgtttttt

SEQ ID NO: 6949 - DNA, 1600 bp, Glycine max
  Soy_ogl_2245 Gm07:7007401..7009000 Cluster 32
atcaaaactgacaaacttgaggtagaattagtgttagaatatgttgaaaactaaattctgtatagtattcagtttaaaggaatggatctcagctcctttttcgtcccaaaacagagaaacaacaacaagaaagaaaaaccagaataactcaagaaaataggaacaaacactacaggatagtaaacactccccaagccaacgccacctccactaccaaaaaagctcagatactcctctttgtgattatttcatcattaaacttatgattctgcaattcttttccccaatctcctctttccagctgtccattatgttcatcatttccctttcacttccaatggatttctccacttcttaactcctttctttcattaaattccaattcctgccaccatgttcttctctcatacaccaacatgcatttactgcccttaccatttttctgttttttttttctctcctgtttggtaaactgaggccattgtttcctactatcgaattcgtttttaataccagattagaacaaattcctggtagggttctgcatttaagctgacatactttttcaaagctcattttggaattatcaatgttctctcacgagaacctagaggaaaataattctcacttcagtttaagtcattaattcctttaaaaaattaaacaagtcttttctatctttcccttattttacttcatgaaggcatactcttatgaaataggagagcgaagcaccagataaacatttgaagaagtaatattgtctattttacattactctgaaagttgacatacatggccaaccaattgtcattttgttaccttggtaggatctttttgaatttgtagacattgctggatttcaagaaattttgtctggaacctatagacttgtgagtgtctctttccctatccgcttgatttctggattgaacctttatattattttactatggcatggtttcttttagtgttgtaagtaactaaaggtgttgtttagtttctgtcaatgctttattaccacaaattttacattaagatcatcgaacttcatgcttgatagagtatgttcaaaattacctaggtgaatctcagtgatcattgtttcctaacacatgtcatgagttatgctagttccaagtttatgtctaattaatacccggtaatgcatttaatttatactagtcctaatatttaaaacatgttaatgtgacatgatcatatcagaatatgctggttttcatatttttcatactactttctattttatatgatccattaaatacattgattatatattttaacagcacaatgtcctcaaattaattcagtgactgttataactttttgtgaaaactgataaaggcttagttgatggcagttggtttttttttttttaaatcttgatcattaattataactagcaggatatgatctctttataattaattgaaatgatccacttttcactgctccaatattttaacaggtacagcatttcccgcgtcgtgcttacggtattgaagatttctcgtcaaccttcgatgaagttggccttagcaacaatgaaactttgtatgtggagaagatttcggcccca

SEQ ID NO: 6950 - DNA, 1225 bp, Glycine max
  Soy_ogl_4331 Gm13:28681201..28682425 Cluster 32
cataaacagagcaagaaagaaagagaccgattatgggtctgattaaaatttgcaataatataaacaaaccacccgagaatcatttatacaaacgaaagtttcagttaaagtggagctttgagaaaatgggaaagttgttgtgtgtgtgtcaaatatgtaaataagaaaaagcagcaaactagctaacggtttcagttaaattgtgcatataattttaggaatcttaactattgtatctctccaccatagaaaaaagtttgagatattttctttatttgatctttcgattaagaaatcacttgaacaagcaaacttgatcatatcttattaacaacttaacaacctccaacgaattaacaatttcttaagattaatcactctctgctggcaggttttcaggcaacattatacctcccattagctgaactaccctcactaatcaccggccaattatatgttgttgattaaaaagtatttgctacactttgtttttctgtgacagaaatctttgctacactaatctgacgcaaatgaataattgaggtagctacatacgcaagtcataaatctaaattttgagcaattaattaatagaaacaaaaaagaatgaaaagaagtcaaacctaaaacttacatatgcacttaaatagctatttatatttgagtttaatggtcaaatgttatcattcaatcacaaatcttcattgatatagcttttaaaaaatttatcctaaaaatcaataaatatatgatacataataagttatgattaaataataataaaaattattttacatttcagtctaacatatattttttttaattgtttgtctaatgaaatcatttgaattatattgttctttagtatttcgtgtctatacattcgcttaattaaacaatctagttccggagtgcatgcaatttatttattttgatcaaatagaccacgaatgaaataaccaaggaaagcatggtctgcgtattatataataatcgccatgttttagttgttagcattcccgaaatcacggggtgttggtttggagatggacaaacaagttgttattataataggtacacacgttcacatgttcaaattacaattatactaagcactatacttgcgaccaatagacagtagtgagtgaatgccgtacttaaacgaagtgattgtccagacatgacttattattgcttgagtttaaaggttgaattattggaatac

SEQ ID NO: 6951 - DNA, 1087 bp, Glycine max
  Soy_ogl_95 Gm01:3886414..3887500 Cluster 32
gatccaaactaaatcacaaaagactggcttgaatttaatattatattcaaaccaaatcaaagcgtaccacacattaatttttatatttgatgttgatgattttctaataaaaaaaattgaatcaaactatgccgcaaacatccctaatcaaagtgtttatgaagttttcactcctcatcagagaccaccgtggcttgctggaatccttatcagaatcacctacgcatccatcattctcagaaacactatcaatgatgataaatacattagtgtttttcacccttattaagctatgcttttgcaaaacttaactaatcgatgataaatacgattttaataaagtccaactcacaaaactttacatgtaacatataaacaataataatactggcaaagacgggaaagattgtaggaaaagaaaaaggaaattcttgcaatcatgtggacccgttgcgttatttgggggaatgggtccctatattcataacgaggaatttacgcagggacgagaatgttggttaaggttagtaagacgaaaacgtagcgcaagtatgataagtcaatgcactttagttgacttatgctacacatgtgcttccttttgttatgttgatatctactcttatctaattgggttctgcctggaccaaccctgtgcaaccaattaacatgttagcttggattatttaaaatgaagttcacgaaaaaattatttttaattaaatatattttcataaatatataataatctgagaaagataaaaagggaatctcatcaagcctacaactcaatacatgcttcctcaaacaaccacaggaaattcatatggatacttaccaagttgcccttgtgaaattcaccttcaaagtctaacaccaccctaaacaattggaggatagtcttagggtgtgtttgcatatcatttttaaaaattgtttttagttttcaaaaactaaaaaacagaaaaagttgtttgattggtgacttaagctttttagttaagttagaatggaaatagctactggttttcaattgtggcctccacagcttatacctgtataaccctttgtttgaacaaccttcctg

SEQ ID NO: 6952 - DNA, 1017 bp, Glycine max
  Soy_ogl_569 Gm02:15615101..15616117 Cluster 32
attaataatataaaaatgtttgcacgaaaataaaattctacataagttaagtaacaaaagttatatgacaaaattatagactaaataataagaatttacttatctatacctttcatttttatgtaacttttattttgtagtctatgtataatttccaaaaaaaaagtaatataatatttcaattttagagggtacccgagggaagcccttgaattaggctttgaattaaattaactgcttattcttatattattcttgactgatatataaatatgcagataaccaacatttttcttactagtatatatataactaaattaaaatggaaattggaaaacaacattaaagacaagccacagtgcccacgtggctgatggtttgtttctattcctagactttttttgtcggaatcttcttaagttactcatgtagtccagtatccaatatattggggcagcaggatatgttcaaaattggttacgcgcggagttgaaattcaaaaccctagcaaaatcctgcagggaccacattttctggctctacctcccataccatacccacacatgttttgtcgtattggattatttgaactccagtgattgctgggtctcgatgaacttgacacgtttagttaatttattcggaagaatttgaatcatcttctaacaagtgaagatgattctgtgtttttgtgtgtctataatatatattcttcgaaaacagagacaacaagaagcaagaaactgtgtcctattttgctttcttatagatatgtgttgaaaatgaacgagaacctgagtaaaagatacaagttaaagcaataagaactgctaattcttatatgtataaaagcatattatatgtctcgtatcttattttaattaactaccgcttgggaaagaagtcctcagaaaagttgaagtataggttaaactttttctatttgataatgagtttaagactgtcgtcgctattcattaattcttctaaaaccacaccaaatatcaataattaaac

SEQ ID NO: 6953 - DNA, 1649 bp, Glycine max
  Soy_ogl_572 Gm02:15653301..15654949 Cluster 32
aatgagaaaagtaaggcatctttaatttgtttttgaattatgggtgtcatgtgacgtataccattacttaatatgtgatacatatatgcttactcttttctctatcatggaaggtgtttgatattgttggtaagacatgaaatgctacggtatatctttaacatctatgactatgatatgatatgggtttagtggaattcattattttgggtgaaatccttagaaaatacgtctctagccttcaccaataaatgcggcgaacaaagactgtcacaaatacaacttgtatggactatgaggcttataacatataaaatattatattatacaattatatagataggatggaatattagaaacaaaaattaagatatttggtaaaactcttcataaaaatatctttgtacgaagatcgtctctgctcttgaatatcgtcttcaatgtcactcacaaaagcataaatgtgttctcctgcaactttttgtttgagacgttgcctttttttttccggctttgaattaacgtgtattttttgtcgctaacaaaagcatatataaaatgtgttctccgaccacgggtaagtttcaagtcatttagacccataaagccagcaagttgcagttgagaattgagatgcttccttataaaattaaatattatttaaactaaaaaatataaataaaatcaaaggtatcaacttttaacatttaagttgagttttttagcagctcagtaaatggaagatgaaccaacgctaagaaacaaaaagaacatgttaattgaagcaattaattaatatttgcttgtgatctaaggcatagatgaatgaattgaatatgattcatctaatttgatttaagcaactagcgtcaatacgaatctatgaaagtttcaattccagacgccaaggtttaagaaaagcaacttctagtttcagctagcattgtatttgttcaacaaaaatacctcggtctctcaagccctgtttagtatgattatcagttctaaattttgaaaattttagaaacgaaaatcaatttttaatttcaatctatagtttttaatgtttcaaattctggttgcaattttcctagtttgtatttgaaaactaagaatttaaatttgcaatcagcaaatcaccacggtgtgatcttaaataaatgattattgaattagtcctaaaatttaggtgtttgaaaaagattgtgctttcggcctgaaagattagtctttagtgataatagtgatgggaaataaataaataaaaaaaaaaaacgtagttgcataagggagcactctacaacaagaccgtcaccttcaaaatggcgaaaaatgaaggtccaaatcattacttgtcaagggttgccctgcgcctgcaattcctttgcttctcaatcaaataggagaactagaataagaccatcacttaattcctttctttcacttcagcaaaaaggttgaatttttactcgctccacgctcttctcagaccccagctgttatagaaacggcagaatctcacgttaatttgggtttcctaaggacaactgctgactacatatgtttcatgcatatgctttgcttagatggatgagggatgaaccataataaccaatacaaaatgcgtgttgaagctaaggatttttacc

SEQ ID NO: 6954 - DNA, 1122 bp, Glycine max
  Soy_ogl_1606 Gm05:5368179..5369300 Cluster 32
taaagaaaatgaatgatgaagagaaagaattaatctaagttaatccctcctgttttcttaaaattcatgttgaaatttcttcaacatagatatatgctactttcagttaaaaacaattggataattaatctttcttcatcttggcattagcaatgtacatgactacatgtgtttgttggtaattttcacggtgaaccagtgagtccaagggtgaatccagactcaaatgaatgacatgcaggattaccaaatatatataattatataaaatatttataatttatctccatatcattaatctaaaatatatatatagtttgttaacatattctcacttcgtttttagttaaatatgttagaaacctacaccaaaattgatagacaaaaaaatcacattttgttttcctgtaattaatgtatcttaggaatattataataatttactaaaaaaaataagaaactaaattctttcttctctatttgatccaacggtatttttttcctccatttttctcttctgtcttctctcacttaccattgtcgacggacacaatcaccgggagaagtcctgaataactgttagttgagtgggaaaaaaaccttgtaaccgcataccctaaactcctttcaatcttcagctagtctatgtagaagaaaggtaacttgggagggggagtcgacaagagcttgtggcgaagagagaataaaattcctattccattaaaaaggtggggactgggaggatgttgtttgtagatcaattaaaacattagttattttattgattaattggtgtaaatttgctagtagtggcttggttttgattttggctttgtttcccacttgcaacaactactcttgtgcgtgaactatttccaatttattgattggttcgatgtggagtgccgtgcaaaattataggaagtggtggaagtgcttggggttgtagtgttgttgcaactattacggtggtgggttatagaagacggagaagaaaaacggagcaaagaaaagacggtgagaccaaatagaggagaatgaatttagtttttattttttttattaaattaaagcttaaattattacaatgtccctaagatacattaatttcaggaaaataaa

SEQ ID NO: 6955 - DNA, 1073 bp, Glycine max
  Soy_ogl_4234 Gm13:23753901..23754973 Cluster 32
tatattttaattaaaaaaattggtagccgttttctaaaaacatttacctgcatttaaaagtattcgtgcaatacacacaatataatactcattagcaataaattaaactcagttttgttgagagctatgcatcactataaaaataaccaaagtagttgtatcatacgataatttgtaacgatgtgaaaactagccggttctttcaattatttcatgaaagctgaagtaacatggtggtgattgatagtctaaaaattcaaaaacaagacagacaagtatttttttgtcagctaaaaattgtaattatataaattcacggtaccagtggtaccaagattgaactacaatgctcgaatacccactgacttgttgctcaacaggggaaccacataacagattacatagacaagaatgaaatggttatgttgtatttatgacagcagtgtatcataaatatgcgaatgatgcatcaaaacttttgatccacgaccaagtctgaaatgagattcctgaatgatgtttggcttttgaaaggttttccctctaaatataatatatgctattcctgcaactccaaagaacccaacaagtacaccagataatctgccaccttgcttccaaagaacaccaccgaatgctgccattaatgcatatgaatcgaaacaggagatcactgttttgatgtccaaccaatcagaacaaaatttccacacttcctttgcatgtttgcaaacaaaaagagtgtgtaacaaggattcatcaacacttctacaaaaagggcagagaaattcacaaccatgcactgatttccacattcttccttttcaagctatctccagaaggtaacctatttctaaggagcctccacaagaaaatattaactaatttaggaggcaccttgatattccatgcttgcatgaagatgtcatcctgatcacaaacagcaccataagcggatttcagccacttccaagaatccagaatgtgttgttgcaatccccttccaacctatttatcatttgtttttcccactcaaaccactcatatatgatattattgctttttttttggta

SEQ ID NO: 6956 - DNA, 1000 bp, Glycine max
  Soy_ogl_6470 Gm19:40239001..40240000 Cluster 32
aatatttgcaagttgtgttgcttctgtgtgagggttgttgaggtttcaacctagtttgggatgccatcaatcctcatactgcaatctagccttttttgctaaaaaaaatccattgtttgtgtatttctaatttaatgctatctatcggttaaggatgtgaaccttagtctgctcttgtttttgtcctattctataattcaaccaatatgcctttaattgtttttttttatccgttcaaattgaaggaaatttacaagaatttatgcaacaattgcactcaattatctgagctagactttatggattccctttaacgggtttaacaatccaaaagtaaaacataaaaggaaaacgaaaaaggaaggggaggttgaaaagaatatatttttcataacattcataacaaaagagatgtgtctaaatctttggcactattcataacattcatataaacatggacagcaaaatcacacaaaaggtccccaccgtaagcctcatattggtactgtgagaggctaagctatggaaagtgtattattatccctcatggctttcttcaatgcaataagtggaatttgataacaaacttgcctttccctcgcagccaccatttcgtgtctggtttctttatcaaaagacaaatttcacgacctgactccttagctgtgatctgtgtcattttgggtcagtggaatattgcaaaccaagagggcagcagaaacacccatgtccatctttcttgtatacataattgaaactcaaatgtttttatacatagtagtacgatactaaagtaaattctttctttggatgctcaaattaaggtttggtatttgttaattgaaaaatagactgttgatagtgtgtgaatatgccttattcagatttttaagtgggacaaattgacatgtgccgaaacagcaatatatacagccaatttcccaaagtacataccgtcaattaatcttctacttgatataaacatggagtcactgagaat

SEQ ID NO: 6957 - DNA, 1200 bp, Glycine max
  Soy_ogl_439 Gm02:7499101..7500300 Cluster 32
agatattagaagcatgatggggataacttgagccaacggagagatattagaagcatgatgatggggataacttgagccaacacatgtttaaggatcatcactgcaaattagaatgtgatgagagacgtgtctcccaatccaaaaacatataccattcagttaagacatgcatcatgcttgaacaacaccgattctgaagctgtgagttcctaatgatccttgataacatccaagtcacaactagaaactctagcaactcaaggaagacaattgtcctagtcaaataaccaataaccaagaagaaagtaggtcgtagcacattgcactacaacaccattgcatctccagaagacatattgcagaaacaatttctagaaaactttccatgattcaaaattcaaaatcatgaggaaacccagacaacaacgtagctagtactcaacggatccttcaacgaacacattgtgcaatctttttaacaatgaaacaagagtatagatgaagacacaacaagtcataagagttgtatgacagaggttgaattggtgcaaaacgactggctacaagaacatggacaacacatggaacaattcgaaagttgaattcaacctccaacaactaactcctgatcaagcctataaattgatcaaattccaaggagcaactcccaaggaagggttgccaaagaagagggtaaaacaaaccccctattagaaggaacctggttagccaaaacactttaggtggaatcagtagaaccaaatatgaaagagtatgtgtcctataacacttagggggctggtgcttatgaagttttctgagaacacaacaagtagttgtgtgggtcctatagcaggtgctaccgaggtgaaatctgagaagattttttgaaaacatttaattactgaaaaacgaaatccttttcggttttagattgattggtgaattctatcacgcacttctagttctagacagcaggatcatgatgatcccccaagctcacattatatattttttttaccaattttataacagtatccagaatttttaaaatatgttatatatatggtccctgaaagttagcacttaaccctagagactgatccatatgtagcactgaacctgtcacaaaatcggagagaaaaacataaaggggaacacttatagttgcctgaaacctgagccacacttatgttacac

SEQ ID NO: 6958 - DNA, 1053 bp, Glycine max
  Soy_ogl_444 Gm02:8445632..8446684 Cluster 32
aagcttgagttttttttccttaacaaatgacaggtgaatatttaatgagttaagcttgaataatttgtgcataactcaaatcatttacattcttatatatttttttaaccttttattctcattttttcatttccctttattcataagttaaccttataactttttatacacttgtatacatgaatgtttactttatatttacacgtgtatgaaattaaaattgaaatccacgtgcttctccttttcaattcaaggaagtacacaaacccataagacataattctactgtgttatttctgcataactaagaggagaaatggagtcaataaagaaaaatcaaatatttttgtttttcttaaatggagaaacccattacttgatattactaatactcgttaaatatagctggatgcctccatgccattgtatatataattaaagagattcataatattaattatggtattctctatatcgatccaaccttaagggcattgcatgcacgcttttaggcttgctcgatgtacattacacacaagcgattactgaagcatcaatatatgagacgctacgaaattttaatgaataatctgtttactataattcatgatcaattggtcatgatgtcatgtcaaatagtagaaggttcaaaactgagttttgaactttgaagtgacaaaactctgcatagattacatagaatgatttttttttttcaattcttggcggtgagcatagtacgtagtcaatccttaagaaaatgaatgcttttaattagtcagtttattatttcgttcacgtgtttctattgttttaattgatttaaaccttcatcttaagcttaaagaaatcttgattaaatttttatcatgacaaggggagtggttatgcatggacaagtacactttcagttctgcattcacaataaatccactatagaattagcaccttatcatatatggccccacgtccttaattatataaaaaccaaagagtaatattatatctttctattaattatcttataaatcttcttactactttataagtaag

SEQ ID NO: 6959 - DNA, 1100 bp, Glycine max
  Soy_ogl_567 Gm02:15607101..15608200 Cluster 32
atacaatcccacaatattactctacgatcgatggtatctcgtttttgagaaagttaaatcaatatattcttgtgtaataattgaaatcaatggggatttttatatcatgcatgtatgagaggtatcaaagtagactattattttctcaatatatatacgaagagcagagaaaggaaaagataaaagaaaagaaaaagatcagttatgcggggatatacgcgcactggaaataagacaaatatacacgtttttattttaaattcatgtttattaggggtttggccgtttgggttatcaatcagaaacgaaggttttccacttgttagttgttactcattttcttttccggggtgtttgcaaatcttcctaaaattatattatgttattttatctgtcaaacctttgaacccaacaaaactattaagaactctcaccaaaagcaacttagtgatcgatgatatataccccaatttagaaactttattctcagtttctcctccgtctgctttaatttatttatattgttactaaatctggccttgttaattagtgtgaaaacttgtatgatttgaattcctaaagaaaataatgagctccttgagggccaattaaaatatatgcatcttaattaatatttatatgataatgatgctatgactattatggatctgttccttgttattatggttgttgttttttattattattgaaaaatcgttagattgttagttttttttagaagaaataattgaatatgtgatttttttttctttcttgttaatcatccaatcaatctttattttcagtgtggttgttgtttacttaaaaaactggtaagatcatacaaggttgcgttcatgaacatgcaaaattgaatgatgtgttccttttttctaatcactttagagaccgatcgacatcttttaaaaaataaaaaaagatataaactttgctatcatattcctttcagaggacatgttttgacttaattatatattagagcaggaaccaatttcttcccacttattttttctattatttttccgagtattgattggttctgatccgattaagtgcgtcgatttcatacttcgtatatg

SEQ ID NO: 6960 - DNA, 1077 bp, Glycine max
  Soy_ogl_3428 Gm10:156278..157354 Cluster 32
ttaagagaccctccaatttcaagtggtggaacaactaaattccataacgaaaaaatttcctacacgctccaaatgtttcattattttaacaattttgaattctgattacctaccttcttaacttaccttgttagaaaaggcaatatatctcgtagcaaaacagaaaacaaaattttgtaatcagagtgcatgtttagaccttgattaattgtaacgctgacatgatcatttagtttgaaagttataggaagatatacgtgtgagactgaaattaacaagtaccttactttcctttcagagcacttggacaatggacatgaattagaaactaaataaaaaactaccacccattcactgtaatatatcatagaagacagcttaattaaatacaagcgtatggactcagtctttttttttgaaaattttaatcaacactgcacgataaatgaatggaagagcaaagagaaatacgtacatgatagtgactggagagagagagacatgggaagcggaagcatgaattgtattattgaaaaagtgaattacatgtacatatacgaacttagagctactttgcagacaatgcatctaactaatgaaaactgttggtaactataactaacctgaagtaataatgttagtaaattggtcagctaatgtaactcaacaagttactaatataattcctatattataaattagaatctataaagagagtaaaacctacatactctctattaaatattttcaaaattcttatttaagaatgctaacacattctctaaaaacaatactcagttgctctttaattaacaactctataagtaattttatgagcaaaacaacaccattgttggagtgcatctcattttttccatgtaagagcaacagttgctcggaagagaaacacaattctttacttttatggattccatgaaacatttagctgtgatttttattatttttaaatgtatttatttattttaattttattttgatttaaaaacttgtaaaaaaaaaatctttttcaacggtctcaacctacttacttattatttttcttatctacatacttga

SEQ ID NO: 6961 - DNA, 1202 bp, Glycine max
  Soy_ogl_5682 Gm17:14040499..14041700 Cluster 32
atctaaacatatcatatcctaactaccaagctcgatcttaagttactagagtatgaatgaaatataattaatattttatattgttatgtaattttttaatatatatttcagctttcatattacttacattttctcgtgtatttctattttttttctcgtatacataataaatgattaaggatataccaagaaaatttttaatcgtactatattaatattgcaaaataacaatcagaataggacaattttttctgtcaaagccctacacaagatattttttggtattagtacaaagtaattcctctcaaaatgagtataatttatagtgtagaagtcagtgtgtaaaattaacagaaattttcttttttatattttcctcttcctccaacagtaataaaagataaactaccatatcatgatatgaaacaaacttcgtgaatcttgagaaatgaattatataacagttcattatactccgtggatataatcaacggctacgccattgttcctcgaaaagaaaatattcttcttggtatgaattgaatggcctagaagatatcaactataagaattcattgtctgtaaaaaaaaatcaggtagccaaacctgtgaaaagaataccctaacccataaaataataataataataaaaaagaatactgaaggaactgaagtaataaaaatatgaaaatttaaaattaatgaaaaaccaatcaagtaacgaaaaatcttagacatgacattcaagaaattagatagatcaaagaaatttccctaacttgcgaagaaaccgaaggatcctaagaacacatactctcaagaaaaccaggagctaatgatgccttgtccttgttggatgtgggttcagtagattttgtgttcttcttctttaagttcattccgatgaacaacttgtttattttcttccctatgaacttcttgtcttcattcttctctctgaaggactatacattacaaggtattttaacctgtacaatgcatattcttgatgacgcaccgacgcagattgagaaggaacaataacatcattgtcttgtttcacacataaatttcttaagaaaagttgcatcttctgtcgcctggcgataaatctttgcatattgagattcttggtgaacgtctaagcctttgaagtcttcattgatggaagagtgactcatctttctcattattgaaatctt

SEQ ID NO: 6962 - DNA, 1200 bp, Glycine max
  Soy_ogl_4261 Gm13:25425201..25426400 Cluster 32
ataagttgtatctgctggaaatttcaggcttagaaacacctgaaaccttttcagactcattagatgctttttcatctgcatccttaacaatttcatcagatcttcatcccttgttttctttgatcaacatagaataattgttcacagatgttcctttactagaggatgtaagcaagttgttaagaaccttttttgcaatgtttgcttccttatcaaaattatcttcacaaggagtgcgctattagtttggctactcttagctagtaatttctagtatttttttgtatgtttgcaactgaaaaacaaaatcttcaattctgcaattcttccaagagagaaaaaatgtaaaatgcaaaatataatgtactaagttattatataatgtgaccaacatagatgtaaactagagaaaggtccgttcttatataatactcatgtttctaattttaaatataatgtactaagtttatcttgttaatactcattagtttgttatgggtgctatgaaaacattaaagtgtatatagaatattatacatcaccaacaataaaaagcacaattacttatattatctaataaggacaactagtaaaaaaatgaaaataaatgcttcatgagaattataaaatgtcttataaaaatgaccatcaattccttctatgtcttatattaagggccgaaaggagtactttaatagcaattagctggcatcttgcatacacttgattcatttcaatcacctccaaaatacgacttaatctttgatatgtgcaaacttaacaaggaaaaatattttattatacaacccaaaagagaaaacacaacaattgattgtaaaggatcattttcaaatgtaggtcgacataaatctataactgctaataaaataatggtcatcatggcacaaccataaaacggatgcaagcttcaagactatatcaaactcattaatttatgcagtactacatttagttgcaagaaaacacaaatggatgatttgaacaggaacaagacattcaacgtcttggcagaagattaaactacccgaacatccattgctcatcttctttctacacttctttcagaattctgcgtggatccttttccccctgctgggtttctataacacatataaaaggccaattcctctcctccattcaagtgtgttaattgaaccacaaggttcagaactagtgcct

SEQ ID NO: 6963 - DNA, 1000 bp, Glycine max
  Soy_ogl_2307 Gm07:9529301..9530300 Cluster 32
tatgtcgtttcattcaaaaaggtaaattttagatgatcattagaatacaatcctaataaagtactccaaaataaaccttagcctttgaaaaagctccaattaattttgtagcaatgacctcaaggaaaatatcagcatatgtaacacctaagacaactcagaggatggaaacaaaacattcttgtatttttaactctccactttgtgaaaaaaggccacaagaaataagcaaaaaatggtctagttgtactcttcataaactcaggtaaaaaaaagtcaactataagagacaaagcatttcaaaaaaacatgtcagattcagcttggtttttgttacctaaaaaacaattatcagtgactgaaaaaattcttaaaattaaaaaaaaaaaaaaaaaaacctattttgaacttgtaacttacacttttgtttaaagatgaagtggttagatgttccagtaatgatattattcaaccagcaaacttgaaaagttactttgcaatagtattggacacgaagatgtagatgttggatcatggatgatgataataaggaattaggaatttcaatcgtaacagattaagtcatcaaataagatttgtgagttgtgactttaaagttatagggatataaatgttatattcgttattattttaacatattaaatatgtgtgaaaatggagggagttaggtaataagtacctataccaacactcattaccataaaattataatacacatatttaactcagattcatgtagtacataattttcttcattcataggaagtatttgtttgcaaatactcattaagtttgagtctaattaccatccatgtgaatgtggaaaatccgcaaaaggatcaaaagaagttaagttgaaaactaatttaaattcaattcaatttacatcatttacactcatacttttaacgggcttactttaattatatttgtaattgacgtgattctcaacatctcccttcatcaactttttcagtaa

SEQ ID NO: 6964 - DNA, 1200 bp, Glycine max
  Soy_ogl_2644 Gm08:12931401..12932600 Cluster 32
aagttactaaagcaaacacttaattgaaggtgaaagcaaaaggaatacaaaaccacttgaacaaagataaagaaatgaaatttaaaacttaaagaaataaatttgtctaagaaaaataactataggaaaatataattgtattgattgattagtttgagttctttcaaacgttctcaaacacatatttacactaaaacacctaaaataactacctatgatcgtgtttgaccattattggctcctcagctcctattttccaggcacgaacttttgctcgtgggattctgctaaaactaatgctctaactgctcctgttgtgctccattgttttttggatccaactttgaagtgtgttttatttgttacatgattgtatgtgcacatgaaaattgggtagaaattctttgatgataggctcacccatgcacccttgaaagatgttttttatgccaagtggttcaatggacctttctgatgttcaaaagcgattcaatgatcttgcgaggatttgaatccctgaacataccttaacttgtaggattctttgaggatgaatcctgattggaagacaaaatagatattacttgtctcattgcttgtgtgctgttttcggttatgtgcaaagcagaggtcaaaatgtcatcattagaagttcattgaccgactttcttgttcttaggtttttttagtgaagcaaccaatttctactgatgacattgctagcacttgaagaaaaggcacgtctaatgggcaacatgtgacacaatgactatatgcaatggatgtttctttattccaaaataatggacagaaaaggaaagaaaaagaaaaacgttgttgcattcaagttgaggcatatgttttgttctgactcacagtcacgctcatccattatgtttaggttgtgtgattgtgagtacgactgtgtctttaatagtgcaaatgtgctcgcttagtgtctctatatcattgatgccactggaataggaatggagtagttgcaacctacccagcctttaattgtggaatgaaagaaacatccattgcatgtagtatttacgtcacacgttgctcaacaaacatctcttttcactgactgcctgcaatattgagtgtacgaattggtcacttcactaataaaactcctaagcaggaaagagccagtcgatgcctttctaatgacacgttttaatctccttc

SEQ ID NO: 6965 - DNA, 1134 bp, Glycine max
  Soy_ogl_6028 Gm18:12102567..12103700 Cluster 32
atagtttatcttttaaatcacaaacctttttattttaattacgtaccctacataaaaaagttaaagagaactagcattatctctcaatgtttatatatatatatatataggcaaatcaaatttaattttatattatatatttaagtttgtaaggaaattctaattctgaaatatatatgatttgaattataattaagttgtaattgaaattttatcatacaagcaacatattgccagagaattaggaattcaactcaaaagttgctgctacctggtgcaatttaaattagtgatatagaagcatcttcctccttaggagaaacatttcaggatgagagagaagaagtgagcagagaactcccttcgagcccacaacttgaggacttggaaatgtttttaggtaagttataaaaaccttttgcagaacggattgaagaagagagtgcagtaaagagtaaagagtaaagagtgtatagcaaatggtgaaatgagaacagtatgccacgtaagcaaaaaggttaaaatggacgaatctctgctttttgaaaatctgagatgccaatgtcacagctcccatctcagaatttatatattataaattggtagatacctattgaatgaataggaagttacaaaaagctttatgtttttcatcagttattcataaagtcagaaaatctcccactagtctgtgctcaatcttcttgcagaaagaaatgtctattcgaacaaatcccatgaaagcagtgcctacattgttgaagcgcctggtgacggtagaaaaacaagcgaatttgaatgatttgaagtctgagttgactaagataaaggacctgttttggatggtgaagaagaatgaagaagaactccttgacacgttaactgttgtggatgtctatattctcaacaaaaacatacgtggagggacacattttccggaaaataaggaattcaactcgaaagttgctgccagtcggtgatatagaagcatctgggtcatcaggagaaacatttcaggatgtgaagctcaagcagagagaagaagtgaacagaacactcccttcgagcccagaacttgaggacttgcaaatgtttaaggtctattataacagccttgattatcaagaaaaaggt

SEQ ID NO: 6966 - DNA, 1101 bp, Glycine max
  Soy_ogl_481 Gm02:10561401..10562501 Cluster 32
aataaaaataaaattagagaaaaaaaactcacctcgttgtttacatacgacaaaataacttggtggtgtgtagagatgaagcatttcatatatttaagacagtgttctttgaagatttatctttacaaaatttaataattctttggttaaaagcataaacaaccctttcctcgaggaagataaagaaatggtattcttgttcttcaaggaaagaagcatagaacattatgaaccaatctttagtttcattcattccctttttgggaccaccttattgatcagtagagcccactagctgagttgttttcacacccacatacatattcatttcttttgagaaacttgttcattttcttgtggcagatattgttgtaccggaccaaaaagtttcaagttctagttgttccacttcaatttttaaatgtaatatatattatcattgatcattgattccgaaattttataaactaatcaaagtgattcgttttatttagttttattctaacaccagcgatttggttttggcttaatatttcgctacagtttactggattaaatagctaaaaagtttattttcttttacaagaaaaaaatatcttcgtaatagaggaattttttaatgaaaattacttcttgagaaataagatactttttctacaataatagagcaaaatattgttactgtatccgtgactcatacttaactagttaactacacaattttcaagatcttcttttctttgacagattgaagatcttattcttagtagatatgcatgtccaaatttgaacttaaatcctatttaagttcctgttagaaacacaactgatttagataaatggtagggcataggagcaggacacggtaaaaaaattcaatttgaatgtgccaaaaaaagaagttctttcttgctactatactaggaatcagaagctggtacttaaaattttccttcatgatcataagagagaatctataaaatcaaactcataacaaattgcaaatgacacaaactgaattgtgtagactaagactgtaaaaatgaatatgataaacatcacaatccttactccgagtcagagaagaaaggatcactactc

SEQ ID NO: 6967 - DNA, 1000 bp, Glycine max
  Soy_ogl_1087 Gm03:44717801..44718800 Cluster 32
ctctattatgatcctgccttcaatcttccacatatataccttaccttgcagatttttacaagccaatcatagccgactatttaaaatatgtctacatagttcttgtttcagataataataattacaattgagaataacatgtttttggctgataagaaaaaactgatatacttaacgaatatataattaaacatgaagctccttccattgctttctagctaatggtaatttttggttatctcaaactatcatttttacttggtaaatgttattgataggctaatttatcaacacctttaacattaaagaacaagttctctcattgacatttttttcacactaataaattttacaatcaaacacaacccatgaggacctttttcaaactatagctaatacagtacagatcaaatttttttattgtttttcccacaaacaaatatactggagcttaataaaaatgtaaccgtattaatagtattcataataagattgtaactctacaacgtttttttgacacctaaaaaaatccgtttttttttcctccggttcaaatatcataattaattttctgattttgatctcacttttttttagttaaaattgtaatttagctctaaaatatataagtaaagaacaattcttatcccatgagataaattttgaaattgacttaggtccaaatctacatatattagtaggttttttatttgttttttctgtgtcttgggtttgaatatccaacttacatttttaacaaattaacattgaccgatcaaattgcattaagaaaaactaaagcttgctggatgcaatctgggtttcatgtatatagatagtatggctggatagaaaatcaatgcatcttttctgcaaagtcaaatgaattcgatgagtttaagatttgtggaggtagctatggaaaagaatgaagatattcaaatactccttcttttgctagagtttaaaaattaaatcctcgagcttgcttatatgtcgc

SEQ ID NO: 6968 - DNA, 1100 bp, Glycine max
  Soy_ogl_1334 Gm04:41297701..41298800 Cluster 32
ataaaataaaaatcattttggctttgtactacatgagtgcttcacttaccttaatccaatgtgtgtaatttggtctgttattaattggttttgttctcctccgaacactcaatctaatgagggttagtattatgcatgacaagccttaatcttgatatcaagttatcagactcgagacatactccaaatgcctattgttcttaatcatcctgtagaacctgtcacgtgaatgttcttccaatccattacttgcaagctgcacacttatttgtacctttggctagtttggttaaacttttcggtaagtattgaagtgaggagaaaaataaaaattaaagagagaaaataaattaaattgccaaaaagttagatgagagaactcctaaaaaagttgaagtgaataaactaattttaaattgttatagaagtttaataaatttacttctttgatttgttttatttaaaatttattgagaagtttactttgaagtggctcttaatttaatacatacaggctctaaacaatcacccaccatgcaattatacatttccttgtcaactgtcacctgtagactttcactttattgaattatacacgacgttttcacaaattcttaatttagtgattttggttgagtgtttgtggcattacatcataaactatctttcaaaatcattccaggttaacagttctcagctaaggcttcctttcctgcatcaactgtcttgtttgagagaagaggccaataatgctacagagtatttgcgaaactccagttccggtagagactgaaaaaaggaagattcgataacatgtaaaaatttcaaatcctgattcttccctggggctagggttgtgtttagttgagaggagagaaataaattagatggaaataaaaaaaatgaagagtaaaaataagtgagaaataaaatgataagtaaagtaatttagttgaagagaaataaattaataaaagatggggagaaaaaaagaaataaatgaaaataaatgagaaatagtacgacagggtttgaaaacttatttcttactgttatcattcctaccagagtatcaacacacatttctatcccatcaaaat

SEQ ID NO: 6969 - DNA, 1052 bp, Glycine max
  Soy_ogl_1883 Gm06:9653801..9654852 Cluster 32
aagaaaaaaaggtgatataaagaccaaaattgatggatggaaagtaataagtaatgacgctattccgttcaaattcttcgaatgaaataattattgatgctacgctatatagaaacacaccctaaatttaaagtcggtccccaatttcacatagtctagctactatgtgtgtgatctattgtgtatgggtaaccgaaaatacattttctctttgattatgaaaacaaccttatataaatatttatacgataaacgctaattaattaaactgttcatagaaacacaacctaaatagtaaatagtcaagttacttttgattttgcctcaccagtattaatatatgcattttgccttttaaaaaaatttacttttgatttttaaaaatttgatttaaaaaaaaaaagagaaaaatcagtttgtgacaaacattatgtctccagcgtatcatcattggtcttaagtcggtgtggttaaatttatgtagatctgtctgctagctaaatcatcaatgctagatctttttagagttgcattaaaggctatgagtaattgagtatcatgcaacaatttctcctaattttgtgaaatgtctatctaattagatgatgatgatcatgtaggaattggcccacgccatccactaggaaagacgacattaggatctgttcaattcaaagtgaaggaaactacaacttttccagtcacttacaatttaaaatggtagaagttaaaggtgcataatataatcattaccccttgttttttgtgggtttaatttcaagaggtggaattgaatgaagacagtttatgatgaactgttcgctgagaacccgagctttgcttaaaaagatcgaaaacgtgtgggcatgtgaacacattttaattttaaaaaataattttatcatataatctatttttatatcatagatttgaggaatcgtttgtaaaagtaaattttttatttttcacactctcaactaacttatcttttttatattcttctcttattataaaatatatatttcacacagagattataagatgaagattag

SEQ ID NO: 6970 - DNA, 1049 bp, Glycine max
  Soy_ogl_1896 Gm06:10663801..10664849 Cluster 32
ataataccagatctacctgaaattttttaagtcacaattagttgcgcttaaagtctcaattttttaagtcccaaactcacaattgaataagctacagtgatttttttagccgcgcggttgagatagcttgttgtttgtgtttcaaagatatgctacacattttttagttctcacgcggcacttttaggtcacaactagccagcccaattcaagaaatgcaggagttagtggtatgaatctttcaaactaacggcatcctaaggtgttagcatgtggggacttaattactagatttttaaattataaaatttttttataaagtgttttttactatatagtgacttaatttcctaaaaaaaactatagtgacttaattataaacttgataaaactacagggaactataaattatttttttaccaaaaataaatatatagtacattttaattaaataaaaattaaaagcttcatttgacttttttttttttttttttacatttcaatcccatcaaatctccatttgatgcgttttttcaatcccccatttgaattttttttccccaattttatgccatcaattcaatccccaattataacaggtaaatggctaaaggcacggacacgatggttggaattcctggagaaaattctgaagagttgcaacttgcaattatatatataagtcgcatgcagacaattactgtacatttgttcgctaatgtcgggaacacctgatttccaagctcggtacacccgaggtcagcaatccggattatttaatatttatcctcatggttcagtaagaaaagaaaaaggtttcatattcagtaaaattttaacaaacaattaggaaagaaaaataataacacactcctaaaaggaaaataagaaaaataaattaaaaaatcctcgatttaatcctttaaatattagggtaacatcacattaatcttctaatttttttcttcatattattaatttcttaaaagttgaagagggattgtattagttgcttacaaaatccattattagaattgacttaagttgta

SEQ ID NO: 6971 - DNA, 1000 bp, Glycine max
  Soy_ogl_3406 Gm10:7499601..7500600 Cluster 32
ttgaaaaatattatattaacttgcatctttacccgtcgagaagaagttcaaacaacatttttatggtttaacctgaacatcaattaatgtaagaagatgtttttaaagtaactccagtttcataataatatggaaatgtattaccaatatctttaaagccaatataaggtagaaccttttaactcgtttggtacaccaatgccccattacttttctaataatgttaaaagaaaatgaaaattggatatgaagctaaagaaaaaagtaacctatttttctcaatatcatagttcaaacttcaaagagttgcatttgtttctcaactgactcttaaccttgtaaataggaatcctaacagcaatagcaacattcaatatacttactactaaccttcagagtccataatttaataaactcctgaagctgaagttcaatatacttataaatttgcatatgatgtgaattgaaggaaaaggtgggagtttgagaccaattcgtcgaaggatcattttgcaaaatggaaggatcatttacaaataccaaaatggaaggatcattttgcaatttaatttagcatatgaattttatgcaagagaatcaaataaaagggctttagttttctgttaccggaaatcgaacgcgggtctccgggtgaaagcagatatcctaactgctggacgacaccggattatttaagtttaagtaaagttttttagtgaaagaaaataaatggattttgcactcatgttaaagtcaactttattttatttatttatttatagtaattattttatgctaaggtaagtgttttttttttttaacattaacgtgctttttatttacaacaaaccatagctggacacgtgttagtttttcattattgacgggaagagagttggtttgtgagttatgtctaagatcgagggaaacaaattagtgatcaataattttttttaacaagagtttgcattgttgtacacacctcattgttaaggatgtt

SEQ ID NO: 6972 - DNA, 1119 bp, Glycine max
  Soy_ogl_4323 Gm13:28392619..28393737 Cluster 32
tgtagccgtagtctataaaaaatatattagcttttttttttatgctacgtgaagcaacgtaaatcaagaaaagaaaactcattttttgcaacctggcccagcccgttgaatctgtggaccaatatgaactaaacatgaactggtcaggctaaccccaatatctaactctaattttatacataataagatatacaatttgtacaaatatgtttttcttaccttaagatgtttattaccagaggcagagtgaactgtgaaggaagctggcgggaccaagtccttccaccatgaaaagtattatgtttttttttattaaaaaaatcatggaatgctttattagttttgattaaattgtctatttggccctaaaaaattgtctatttctagttccataataattacaatcaaagcaaaccaagatgtcaaatataactaaatctgtattgaacaaagtaaaagatttacataggaccactcaaaactcatgcaaccatgtgtttaaaagcacacgttactattttaaaatgacttgtctcaaactttactaaataaaccttttatcaattagtctattttaattggttgaataaagtatgtcgggttataaaatgtgagttctctcataatatctttaattctcggagatataagattaattagataatttaaaaaaaaaattgtaaattcaatctcttttattaataaaaaccatcaaactaacaattaacatttcccattaaaaaattatcttcctttcctttactacagataaggtaaataaacctctttaatttaagccatatcaaacatcatataagaattttagcacttgaagaggagcggcattggaataaccagcatgggtgaagtggaaaattaaagcagtgtgatgacctcttgattggtgactagagagaagatggtaattgaattggattaggtacataatgactagggcagttaaaaaagattggaccattttgataacacactgcactacactactggtatctatcactatccactctttttctcatcctattacaggcagaggcggctccttgtttgtaaatggggtggtcatggctacccaaaagaaaaagaaaaagaacactttat

SEQ ID NO: 6973 - DNA, 1103 bp, Glycine max
  Soy_ogl_5429 Gm16:37034198..37035300 Cluster 32
tttggatccacagtatatatactagacaatatgagatttacatattttaaactctactttagttttaaaaaaatctcttttattcctattatctctatattttcattctttaaatcaaacatactcttaataatgactatgaatgaacaatttttatactactataaataaaatcatgtctacataattttttagtcaattcattgtatctattcctattgtaaaaactgactagagtgttgaatttacaaatcaccaaaccatacttgaacttgtaaaacttttataaattctatatccatttcaaatattatgtttcagtgaatacaacttattgctaataacatgttttatttttccgttctggactcctcaaaccaaaaaaatagattattacttattacaaaatgatactttggaatgtgtgcatccaacatatatacaaatgaatgtgttttctcttccatccctgctatgagtgagaaagtgataagtttttttacattaaaaaaaacttatcactttctctctcatattgaacacttccaatatccaaaaggatctctttctgaatctaaatatatccaaatgattctttagttttattttggtttgtaacgtagaagttcatacaaataccccaatcttgatggttaaatgtataacataaagtctaatgtattaattacactccttattaacaaaacaatttgggtaaagtcgagtcacgtgaactgaaacttttcaaactcactatccgatccttatcttggaggcttgcaatgtttctcaaatttgttcagacccacttatgtatccaacatgagccacgtttttcataagttgggttggatcataatatgaaattcacaggttacccaactcctgaaacatcctaatgacacatgcatcatgtgttgtagagagacatgctacctcatggatggggcatctagtaatatagtatgctgatcacatgtaatctaagaagttatccaattctatttctattttaaattaggggggaaattcccctttaaacctctaaaaccattcaaagggttccctctctccttttccatataccactacatatataaatg

SEQ ID NO: 6974 - DNA, 1100 bp, Glycine max
  Soy_ogl_162 Gm01:44485401..44486500 Cluster 32
atggataagcttctcaattgtgtctcccttgagctactttttgtttgatttcctgtatccatttgccacttgtgtgagttatgtacgtgtatattttccattttcttcttttgatcagtacttttataaaccattttagctttttagtgggagactctcatgcccgtcaaagcttggcttggccaagattctttccacccctactgtccaaaatgtgttatacgtttagaaagtaatttccagaagttgggagaaggatattggcactagaaaatagaaatataacatgggaggtgcaattagtaattattgagctgtacttagtaattatctatacacaattgagcacaggcccatgaatggacattgccattgaaaatttggaaacactccttgaaataaagtactcacaattgtgtattgaacattaaaagaacatatttatctgaagacccaaaaataattactatttcacattaaccccttaatttattttaactatgttttctttgaaaacaaaaagtaaaaagaaattgaaaatcttgtttttttaggatgacggaaaaggaagctctttggatgggagctaggaatgtgtcacaaattttattagattagcgtgtatttgatcgaccaacagggttcaatataattagtaaatagttaaatttttaatcaagttgctaggagtttgattcttaacaatgtgtgtgaagaagattttcttagaagaaacaactcaactttgataatttttatgtctaaaaaataattagtttttacctattgatgagagaataccttggttaaaaggaacaaaaaaagagagaaaaaaacatgcatttgatcgcgagactaatttcgttttgcaaatactcccataacatcgatccaatgaataaatacaaagttgtgtattttctttacattgttttaggttatattaaacgtgagggaccccttttatctaacttgaaatttgaaagcatgagataggtacggggacatcacgtctgaagtggcatgatgtgtattaatcgtgttagtgtttgcttattgagttgtttgttatgcttctttgttttcttttattgtgcgca

SEQ ID NO: 6975 - DNA, 1100 bp, Glycine max
  Soy_ogl_1985 Gm06:16339601..16340700 Cluster 32
gtccctaccacggtcccacttcaaggccattggcaactgagtaacatcaattattgtgtattcggttgctacttttttgaatttcatgttcaagtcttttttaatatatttggttgcacaatatacacatccagatcaatttgacgatcagattttatgtccataaaaacaaataatcatttgcgaccagttattgtttgttactaaataatcaatcactttagccaccatcttaaaagattacacgattagtaaaggaattgacaataaatttaagtacttacaaggcttggagaattgacaatgcaatatactactctccttccaaaattggtttgcgacaatattgagaaggcttgtcggaacttcatttggggggatgagtccactagtaggaagatgcatctgattgactgggattttgtttgctctccgaagataaaaggaggtttgggtcttcggaaaatgcacgacgttaataaagccttcatgcttcgggctagctggagattctatgataaaaaaacctcccctttggtcatctgtcataagaaataaatatagatgtggagaattggagttggtactagagtcaaattttggagtgatagttggttgcttgggagaggaaccttgcttagatattttgtttcttcaatgtcagaaagtgaacttaatcttacagtggcaaactatgttgactcaagcagaagatggatggtggaaatattttcggattaccttccaagtaatatcacaaatcagattcctgtgatgattcccccttcagtgaaggcttgtttccataatgttgcttggaatacaaccggtgatgaaaagaagatttcagtacttacaatagaaactagagttatcagtcacaatttaatcgccaagggactaagtaaaaataaaataaataatgacaaaaatcagtcggtcacaacttcagcctcttaataatgactgttactaatcaataattgtgattgttcttattttggttcacaccccctagttcacaaccaaaatatattttttaaataaacatgattttttttttaacttgggtatgtttttttaatcaatgactaattcat

SEQ ID NO: 6976 - DNA, 1000 bp, Glycine max
  Soy_ogl_2041 Gm06:39075101..39076100 Cluster 32
cactagacttttcacaatattttgcagcatcagaattacaacttccattttcatggattctgatcttctatttctttacatgtttcttgctcttttttattcctagagacgatggataattagatcattaattagatttttggctcatttagcccgtcactgcaagacatgaatgtttaacaagtttgatggcattgattggattagatgaacaatccagggaatctcaatatataataagcaattgagtttcctttgattaaaaattatgaaaggttattagaaatgtgaaaagcgaactaattttgtgtgtggattcatttcacgaccgatgctacaaggcagaattttcaattgaacctccaagttagccataaagttaaccttcggtaagaaatttgttgaataatttattgtgaatagtcttattactttgaacaatgttattgcataaataacatgggtgggttaaaaaccaatgttcatcacatttttggatctttgctcgttttctattaatcccaaaacgttatatggatgcatttgtgggaaacattgttaacagaagaaaaacaattttttggctgataaggattattttttataattaagatttaaattaattttatttgaattcaaaaatccccaccttagcttgaattcaacaagctactcattgtcatataaggccttaaggggtgctcaagtgttgcaaggaccaaccaacttggaagtgacttgggaggcgtatttgcaagattctcgaatgcatggatttttttcccaacttgaccaacagtagtatctcaaataaagaaacattttgcatcaatgtatattgactacactgctcaaagagaggacgaggaggtggcagccgaggaatcccatgtacatatccaaaattcctaaaccctctttggaagatacaaccgtatgtctatcccgtacatgatgtagccaaagtagtatgtttggtctgtaaaaggtctgacatgct

SEQ ID NO: 6977 - DNA, 1000 bp, Glycine max
  Soy_ogl_3035 Gm09:6766501..6767500 Cluster 32
tcaacttaaacaaaatctgatatctttgtgggaccacaactacaagttaaaaacaattgcaaggtaactcagtcttgtttattttgagacttgagtatcaatacaaacataggaagtgagtgacccttacactagcgagaagaatcatttgatcgttttggcacattgagagtgaaaaaagcatagatatcctgaaagaacaatgtggtcattcctgatcagttcactcattattctcagttttccaacattctaaaatgttgacgcgcaggaatatcagttagatcttttactgaacctttatgctcctattgctgcactagaagtaggatatgtagatgaaggtggtgagcagcataatgaccaagtggttgaggtcattaatgtggagcagcataaagataattggtttgaacaagaaatatgttctgaagtcaaatggtgccgggctttagacaggtatatatcatttaattttgtataagctgcctatttcatatcttgattttgatagttcatcatcaatatttggtgccacagtgtgtagcttcgaggggctagtgagttccaaaatctaaccatcctttcaacaaaacggtttggaaaggtattttcatctgttattttatagcaaagattttgaatgcaatttatgttttcatccaattcttccaccacagtccacacacatgatatgaataatcttaatgcatctaaccatcaaacacatagtcatgcatgtggatgaaacatcgtgattgtttatcacatgcgggcaccttttcttttttattagtttgctgctcttttagatgagagtctgtacattctggttttatctaacctttttttattttttattgatggactttcaacaagagcagcttcctggtgttatttaaacttaaataaaacaattttaaaataaatatttttttaaaaagtatttttattattaagcatatagaagaattttcttcttaaaacaaacaaaaaacta

SEQ ID NO: 6978 - DNA, 1100 bp, Glycine max
  Soy_ogl_3432 Gm10:37262501..37263600 Cluster 32
tgagactgtccaaatatatggaaaaggaaaatgaatcagaaactttgtaatttactctgagcaatgttgaccagtttattaaattcttcgaatttaatttctaaaaactatcattagctattgtaaaagtaaacaaaatcactgcatacaaaaagtaaacaatacatttagtatctattcaaattctttactggttgtcatattgacaaaggagaacttgcaacaataattgttgtaaaaggttattttgtctgtcaaaactaaaaaaaaaaaaaagttttactttgaatcaaagatgaatataatacccaccaaagtaaggtggaaagaaaagtacactcaattgtctaaaggttacttttaatccaaacatttcaaggcttcaagccaaccaggtaaacaattaacaaaaggagactaaggtgcggatagtaatttgttttccttattgtaattcacctatccgatacatatccgttatcaaaactgtacggatttcttatttaaccttcaaatattcgcatcttatatataataaacaagttaaagatttaaagatgatctatttgtttttaaagaagtcgcggtttattctctttcattttattattttgcctaatcggaaaacaaggtaccaatagacaaatgaaaagggaaaaggatgtaaacccgggtctaatcccattcaaagttaaaccaagtaccaaccttgtaactcaaactaatcccattcaaagtcttgttttacttttttattgttgtttgaattgaattggcttgaaaattttaagagaacttcaatttaggtagaatttggattggtaaaaattataaactacaattaggaatcaaatctagccaagttatctaataatttagctcggttgaggatgtatacttacctttaatttaaagtggtttatgtttacaaaatgccttaattcaaaggataaagtttcattttctcactttacatatctcttcactttagagaggcaatgctagtggagaaaaccctcattcaatcctaaatggataaatctcaataattacttttgagaaagccctcaatttgaaccttcaaagttacatgtaccact

SEQ ID NO: 6979 - DNA, 1100 bp, Glycine max
  Soy_ogl_4025 Gm12:8283801..8284900 Cluster 32
tgtgaagtacattaggatgaatgatgcagcacacattacaaacaagacaagtaacggcattctagaatcacaatttggtcaacctccactatctcttatgaaaattcagaaccaagtcaacccaaatacaaatcaaactaatattcttccatggttggagaatagttggtcctctacaatctcaccgagaaacttcggtcatctaggcataaaattaaccttctagaaaaactccaaatttcaattcgttagtttaggccaactttacaatggacttgctttgaccccaatacgatggttcgttctgcctgttttacgtgtaaatatgtttgtttcatctgcggttagaaatgttggatgaacgtttcaatgcaaatgatgcaaaggataaaagtaaaataaatgctaaaacaaaatcctgatccgttaataaaataacttttgtctcaaacataattttataatgaagaatcaaacatgcactataatgttaaatattatattgcagtcagcacatatttttaaggaagtcatacaaattggtatatacttgctgctgaatcgttgtaagttttgttcctttttgttcgttagaccacgaacctgttggttgctcccattcgttcacgtaacctatgtgtagaaaaagaccaatacaagtcaggcatttgataaacattctccaacttggcataaactaacaatctgtcaataacatgagcccgtaataacctttttaacagaaataatgttctcgtgttgatctcttgtatgtcgattaaaggtaagtgagacttaaaagtaaattttaagaggatatgtttttcctttaaagaagaattatagattaagtcttttcaattactaatatatgtgatatttttgttaacatatgtgatttttttttataaaaattaataacattttttttactaatagacctaaatcttaagttttaattactttattatagtagtctccctggtctattgaagagaccaaacccaccacaacctattatatttgcttggctaaaattgtttgtggactggctggattttaacaaatatgcagctatgagatccttacaatctgaattc

SEQ ID NO: 6980 - DNA, 1000 bp, Glycine max
  Soy_ogl_4266 Gm13:25754201..257250 Cluster 32
tgtccatgtatatttattggcagctttaatccttatttggcatggtgagtcgttatggaatgagaagaacttattcacagggtgtgttgatgtccttctaagcaagaagggtatagatgaggcaattgaagctggaaaaaaaattagcagcattccttctgaagttggagtttatgcctatactagggtatgttgtttatagcccttttaagaccctttttttttttaatgaaatgtttaacaatagatattatttgtctggaaggctgcaatggcacttggagaccactaccaatagattgaatagaacataaaaatggtcttgtttgtgaaattatttgtcacgtgtctctgtgtgatatgttattacttatatgattgttatcgatgattgctgattgctgttgttatgtgttcttcttgttaaattaagaaagcttcgtgaattttatgaatatctttgtatatagagtacataacatcagactcttgtgtagttaaaaaaaacatgagcttgaaataacactataaatcaatatcaatagattcaggtagtaagaaatagtttccctcaattataaaaaaagttttcctcaattaattaagatcataaattcatttttttcaattgaaaaatagatactggaagaaattttcttccatataaatagatgtaccgaactcgagttagattagttaagatataatgctacttttgatgcctgggtcatgtgcataaataataagctaagtagtaatttgttgtacttttataaaataaaaagtttaacttcactccatatgatagggaccgccaaatctagcatccactttaaataatattttattatgggtccagaaatcctttaacctacagattatttggatttaagtcattggttactcttcattggtagacttaaatacaaaagatagcataccccatagcgccactaatcataataaggaatcaaaataagcaggaaatacaatacaatta

SEQ ID NO: 6981 - DNA, 1000 bp, Glycine max
  Soy_ogl_5362 Gm16:29124601..29125600 Cluster 32
gatgaatgaagatggctccattcaggcagcatttaaaaaataaaaaagtggtgacgatcgagtgggtcgttgtttgaggttgctatacgatgaaagagaaatttttttctctaatttaatttttttctcttaccttctcaatcactaattatcactgtgttctatgcaccatgtgggtttatttaatttatctactagtaagcaatatggcactacatggttcaaaattcaaatgttgacaatacgaaataatttatacatcagtgagcttttaggtgtattgtaagtttaatttcattagatacccacaaagtaaagcctagggagacattagggttgtgatgtttccagcataaaaaaatgaattgagattccagtttgctttcttgtgagatatacattccaaaaagatcactctttcaaagaactttcattaatacgaaactcttgacgtttggttaattttagaaaaaccaacttttctgttaaactcaaacggcagttaaccaaaatgtgacgcagagtcttatgttttacatgtacaacaccaaaattaattaattccgaaaatgtgatgcataatatataaaggcacagataatatgcacaaaagtgtaatccagaaatgcatcacataatagttataaaaaaaaaatgctatatatagccactaatacgtaggatatatatgggaccaacaaatggagtcccaaattgcacccaaatgcagaacatgttcagcaccaatatacactaaatgcaaattaatatgcaccaatacattaatatacagcgctaatacaccaaagtgtagtcccacgatgaaccaaaaccataaattagtcatatgcaaaattataaactggacctatgcctttacacacacagacacatgacacacccgaccctcaacctccattccagcggtattatgtctacaactacctctatggtaaagttgaaagtatcgaaatatatgttaatgaataataaaaaaaat

SEQ ID NO: 6982 - DNA, 1003 bp, Glycine max
  Soy_ogl_6111 Gm18:49109001..49110003 Cluster 32
tttattgttaaattcttagtggcatgggttttcactaaaaaaatatgaagtttattaaatgggcttgcccgtaggagggatcagtgaaagaacgatgtgccgtgttcgccaagctgcttgtaagaaacctgcagcccatgtccttcattgcagggaatagaatctgaacaaacatatatgaatcattttttgttttcttttttctattttcttgcttaacatggaattgactctatgatcttttaccacagtcttagcagcacttgtgatatgcacaagagtgacactattaaggatgatttcttatccaattaatctgattttgttaaataaaaactttgatggggtgatctaaacaaactacaatcagaatctaaagtctaaacaaaagtcatggtttcagataataagaagtagaaaatgctcatcacacatacacaagaaatacacatgagttacactatctctatgactagggaagtgtaattaatgacaccaatatgcaagagggcccaaatatagaataagtatatatacttacatgcaggacaattggagatctttgaacatggaagaagccccccctcctcaagttcactcaaattcttaaaacaacagaaaaagacttataacagaatcatattcttcagttcatgcagaatctatccaagatgctattttacagcagttgaaccagaagacttataacatattcatttgctagaaaactttggtacatagtgtgttgcagaggaataaaaaaatctataaacaagaaaaatttgtaacctaataaaaataattttctcacaaaacaaatttaggaattcctatacagagaagcagaaagatatatacgtgaaattaaaatttaaatttctagctccctcatcctactgattgcaagaatatcaacagctcataatacacttgcattggaacaataaaatatacgttttgcaatattaaagttgaattcactgagtaagaaatatacagactg

SEQ ID NO: 6983 - DNA, 1100 bp, Glycine max
  Soy_ogl_1357 Gm04:42993101..42994200 Cluster 32
tatgataatttcctgcctttgtattcttaatacatgtgcgatttaagtctagggcactttcaacttatagcatgtcgattgcttgaaattagaaatatatgctttaagaattggtatgttctgtttttaccctgtgccacgaattggattatgatcgattcagaatgcttctgtaaatttcctttggtaaaattgcagccctatttgtctactttgcaacctaattggtttcactttatttccatttgtctgtgatttttaatagattttaaggtgaagcatgttctatgaatagagaatctctatagatttgggtttgtttggaggatgccatgttttgtgagtctgcatgtatgtatgccctgtacttttatatgagaatggatgctctaaggaaattcagaaagctggaattacttcatttgcatgagtagagaataattaggaaattgtgaagatgtggttgtaatgaacataattttctggaaatggttttaactgtgttaaagaactttgatgctgaggcatctatgatggttgagaaagcttgggagaagtctcatgaatttcttgatgtctttgaaaccccccttaaaaccttggtttacatgataagtcttccattttactattttccccacccatgagacttgttagttggaaaacaagttttatatataatacacacatatataaagggtatgtgtgtattatatatatgcatctatgtgctatctctcctgcctttttctctcactttatcacaacctcactccctttgtttgtctcttacttgtcttgtgtaaaagtataggaactagcaaagactcgtaaggtcaggtggagacaaaggatgttagtctcaaccattgaagattgcttacttgttaagccatttgaagtgttgctactagggttgacccatccaacctttcttttgcaatttcataccctaaataattgccctcttgtgataataaataatgagcccgtgagaaatcactataatacgatgtttagctttaaattcctgattcttccatgcatcattataaatcaattacttactggaacattatgtatgttgtttagaccaaggc

SEQ ID NO: 6984 - DNA, 1040 bp, Glycine max
  Soy_ogl_6459 Gm19:39576801..39577840 Cluster 32
atgttcactagaatgaagatttgagttgtcaatttgaaaagcaaaacttaggtatagtgcttcattagtgttctccattttaaagtagtgtatgatagtggagttaactttttgctcctacaaatattttttttattttaaatttttgtccttaactgttagatttattttagagtaacttacacttttttaagagatatttaagttacagtttttttttatcaagttataagtacaaaatatttacaaactttgttgatgattaaatctttaagatcttatttaagaaatttaaatttaattccttccgtctcgtatcattgcccaagccaagaggaatcactactacaaataaccgaaaataaaaaatgaaatacccaagcacaagctgtcccttctatgtctaatgctctagcagaatcagaactgaggttcaatccctgccactgcatgtatcgtcattcaaacataaaatctgtattggatgcagataaaagaactctcattgcagtaaattactatattatactcaataaaacatcaatatgcaactgcagagataaatcacatacttaagcaatagttaggaaataatagagcaaacacacttcatgaaaatgattgacctcaacttgcaaacaattagaaacatccacctatgtgtgtatgaaaatttccttgcaaaacaaaatactataaaatatttgcattttcaactctcccgtcttttaaatttcacacagaaataataccccgcaaccttctaaggtcacacacactttaatgtcctctttatatttatctatagcaatttcaccaacaaccagaggaaatcaatcttaatttaaggtattacccaaatattttcttatgaaggcatgctaattctacataacaatactcttcgaagattaaaatgatttcagaaattccagccctatgaatatacacccaaagttggtcaattaaaacagtagttagaatacatgttatccaccaaatacttgcaacaattctattgcatcataccttgtccagga

SEQ ID NO: 6985 - DNA, 1400 bp, Glycine max
  Soy_ogl_6883 Gm20:40085301..40086700 Cluster 32
agactcctaaagcttacgagtacactagggtaattatttaacacatcacaatatttactttggtacatcttaattacattagggattagataatttgtactacaacttatattacagattacccaattcttactataattgggatgcactaaaataaatatattggtatgttaagtaattaccgtacacaaaaatctagtaagacacctaaatatgtatgttcacggagctgctattcaggcctcaattgttattatttttaccatgttttattttttgatgcccatagtatagtggataaaatatttagtgtgtattatgattttttgactccctcttttcttttcttttcaagtttctgccaccaaaccatgcacacatcccaatatccattcaatttaagaaaggcactaagccaaacaatgcaaaaagaagttgtgaaagtacatggaatgcatacaaaaataaaatcagaagtgtatttctatttatttttttagtggaaatttatttccattattttatattttgtatgcacttcctataaaacaatattatcttctcttgtgagtatttttgtgtttctctttcatttctccatttacctgttttgttccttcttctatttttacttaccgactcgttcattcaatttctacagtgagtcaccgtcactattaccgccctttactcggatgatcttgtgtggcatatcctgttgtttctagcagtgaaggatcttttgcgagtgaggtgtgtgcatgcaagtcatggaattcgatcatctctttttgccaaagatcacattcgcagatcaatcaaagaccctactctgaccaaccatcacttgcctttaccaggtccagacctcgtgatcttcatttcttattcaatcaagtcactcacaacttgcatttgcctttgaggcgcacaaaatacaaaatattggaatattggtgtcatcgtttcatctgctttatgtctttggatgataggaggccaattcatgcacagggatggtgtcaccagactccccatccattggtcgtcgtatgggaatgcaagttttatgtggtcattcttttcttagaaaactcggttttaaaactggttcaacagtaagatttcggaggttttggttatgacacgtacctgagtgacaagtacaaggttatggtcatttttcgttctaaacatcaaataattataacaaaggtctactcttttggaaatacttcttacacaacatatgagaactctaatatatctgtggttattctatgattgcatgggatgccgcatttctaaactctaatagcactctaaatcggttggttgttgatgacagttcttcattgcctgaaagggtgaggcgaacatatctaatagtcaattttgat

SEQ ID NO: 6986 - DNA, 1042 bp, Glycine max
  Soy_ogl_1592 Gm05:4730959..4732000 Cluster 32
attaacatttaccaatgaaaaatatttgctccaaattacttttgtcaaaaacaaagaagagcaaagtttctccttttccattttagtcactataggtaacaaggattaggcataatatatttctctcatttatttgatttctctttgtatggtctcaagtcgcaatcaaaagagatatggtgaaaattgaagaccagagttaagatggagactctccattatgtagcatatttgtgtactgctagagagatctaagttgccaactatgtaaccaaattgccttacaatccttatttcattaataatttttctgcagttaactacaaacctacaaggcattcctgctacacttatgtgtcatcaacccttttctttaacctacatggcatcacgtgatatcctttgttgcaacttgcaagccattatgctcaacttcactttgacttgtttttgctgtttgtattaccctgcatttctaaaccgtcaagctttttagggtacagattggggcgtaatacccagtgtttcctatagctaaagtgttagtcgaaagaccattgtctgatttggaccatgttttaaatcacaattatagttacattttggtcattcaaattgtgaaaaaaaaaaatgtaacacatacacttgcggtggtatcaaaaaccgaagtattaatgctgcaattgcggtcacataaggaggtttttaatggcggggatgaagaaagaaaacgtagataaacataaaagactaagactgattaatttttttgtttaaggacaaaaagtaaaaacttgaaaagtactgaaaacataattaactattaaaataacgattccggacaaaaacaagtattaattaagccagaattatgatttttattttcttctctgtaacattgctgtaaggttccatgccgaagttgtaaggaattaaactatgagcatgcttgttttaacgttcaaaaccctccaagcggacgttcagttaaaagttggaatttgtagtttctcacaaaacatagctttggaacgtgtgccca

SEQ ID NO: 6987 - DNA, 1000 bp, Glycine max
  Soy_ogl_5380 Gm16:30724401..30725400 Cluster 32
aacagtgataatattgagttggcactagtcaaggccttgttagcattttttgagagtgcaaacagtgacagtatcgagttggcactggctaggccttgttagaatttttgggagtgcaaacaatgacaatattgggttgtttcatgtttttcgcccccacacaacagtttattcttcaccaaacttgggctttttctttctatacccacaataactctctcaaacccaacctaaagcaagaggaaaaaaaatgagagtgtgaagtgtgcgcgcgcgcactccctctataataagcaacaaatatcattagcaagcttgccacctatcctaatgactatgctccagccacattgtttcaagactattctcaccactctataaataggagaccatgcatgactcatttctcaccacagcaaagcattccgtggtgtgaaaggtttggagtagtaaagaggttctagcaagcaagtgaagaggagaaagctaggtgaaggtgcccttccaccttggtgatcagctcttggaggagaggaagagaagaagcaatgggggagagaagggttgttctttcatttcatgatgttgttgttctatggtggagttgaagtgaatcttggcccccaagatcatctcacttcatgttcttgttatttttttggcttgatccttgtgttcatgttgttttcatgttaatgtgttgtttccaaatttttaaatgatataaaatattgctatttgatccatagaagccaatattcatgttttagtgttaatgcctcccaatttttgggaaacatgaaataatgttagtttggttattagaatggatcaaaagcatgtttttcttgaaccttgtgatgaacatatgtgaactcaagaaataaaaagtagaatgaggtgtgtttgactcatattgggcaggaatcatgcttgggaacatgttcgtggaattgttttattttctagataataaaaatgcaagaatgaaataaaataa

SEQ ID NO: 6988 - DNA, 1100 bp, Glycine max
  Soy_ogl_1627 Gm05:29138301..29139400 Cluster 32
tgtgatgatatatcatgcaaaaataaaaaaataaattgtcaaaacataaaagattttattaaaatccctaatcctaaactcaatggctaggttaacaagttgctttgatagatataaagttataatatataccaatattaatttgtcaataatattattaatactaatttataatatataattttttatttagtaatactaaatatatatgtgtaattttagatcccattgaatatatatactctcaatctgaatctttcattttattttaaatgatcgaccgggattaaacaactatatgttactttcaatcttacacgtgacctctcttctcatcaattttcaggtgcttcccaatccttcttccattgagtcgttgttgccacctagtcctagacaccaccgcccaatccactataacagagagtacagtcgatgattttcacgaatactacttgcattggtaacacaaagtatcagtgtataaatggattcaagtgtcgtagcttaaaaatggatagtctaacatgtcattggattggaggtttcacgtggtggcttgtgattgtagtgaacgggtggaactagtgaatgtattatgcagggggtgtgatttctttattggtgggtttcatgcatttcatgtcatgggtggaataggtagtggtaaaggctttgggtttaaattggcactgtttgaactttaaagtgagtgtaccgatgtcaccattgaaaagcttgaagagacattcttgaaaaattggtacgggatgagaagatgaaaggtcctctatgaactgaaagacagaggttatgaataggaagaccaaggtcacgtgcaagattaagagtagcattgaggggattaaaattatatttaaatatgttttattttatttttgttaatattttatttacgttaaagtatacattaatggttgaaattcacgcaattaaaataaaaattgcagagaatcttatccctaaaacatagaacggagattttattaaatttcgttgcatcctacttcatttcttaatatttttttaaaacaaaaattaaacaatatcgttctgttgcggtaattgagttataggaa

SEQ ID NO: 6989 - DNA, 1100 bp, Glycine max
  Soy_ogl_442 Gm02:8386101..8387200 Cluster 32
taaaacaataacaactttgatagcataaaagacaaaagaaaatgaaattataagtatgactaagcatacacaaaattttaatgataaattaatatacaagagaaggtcaaactcgttagtctggagcaatagcaatgagtcagtaccaatcttcatattgccaacctaattaacattgggaagccacttaagcgacggcgtgatcaatgccgtctgaatgagaaggcaaaagacatgatcgtgatcaaaacgacagcagaatgcgtagccccttgtttttgtggatgtggaaagtggaaacttagggtttttgttgattcacttctcactttcttgttttgaaacctgtttttttttttaaataatttgacaatacagtaatcaatttctcatccaagtctatcaaaaataaattttcgtccaaattttattaaatctaaaaaaaaaaaaccactaggatcgttttttttaaagtacactaggattgatctagtgattagaggtttaggtagtatatgcatgagatcttaagtttattttttattattgtcatagtcattgtataacaaaaaacacttgaaaattatttttaaacaagtgttttaaaaaccaaaatacagaaacaactgtgagattttcaaactcaaatatacttttatagtaaaaaaaatgaataaaatacataatatactgttgatgaaaaaaatctaactatatatatggtttttgtacaaatattcgtaatattaactattaattttgtcaataagaacttattaactttattaatgtatcttctaaaataagttgttgagtttgagaaaggcgaatcacagtaaacagtcttcctcgtataattatcggcaaagtgattgtccttttcgttactttccattttgaagtgtaattaatatgaaagaaattaagagatgagaaagaagttgcagaaaaaacgcaacactgcctcaagtcaacaacactccccaccgttagtgcagcaatctggccgcagggaccatggttaataaattacttttgtaatattgcttagactttcattactttctttgacttgtttgtttctttaatacgtggatgca

SEQ ID NO: 6990 - DNA, 1400 bp, Glycine max
  Soy_ogl_1314 Gm04:38852901..38854300 Cluster 32
ctatttcaaatggaaaaagataagagagattgttttttccataaaacaaaatgtccttagtataagcaaaggaagtgcccatgtaaggaaggctaaaagcaacccaagggatttagatcccatgatgagacaaaagatgccaggttttgcagcattcttataaaaaaagtgattgtcgagtgactcttatgccgtattattatggtctcgaaagtttggatattctatcttagagacggataacaaaatgaaattaaaacaaaataaatggaacaaaaattaggattcaaacacaatcaaatagtgatttaattatcaacttgtaccacatcacccacttcaacccctccttccttaaacaagatgttattattccacggactccaacaagatgcgtgccaaaaaatgagtcaaaaccttttcttcctcacccgaattaggtgtaccatatgatcataaagttgatcgatacattaaggcatatctatgtcaatcctgagccatctaaacaactcttttcacacaatgttagcaaaagagcaaacaaaaaacaaatggtcgacaacttccatatattgcgttcaaaagggacacgacaaaatattttgtcggcaaccaatccaggagaagccgccaagagaagatgaggactttagaaggtgcttcacattttccaaaaataaagcaatggttattgaaccaaagaattcctcgagttggagttgcggcctgtagaaattaacatatacgctgaagatacaaaaaagcacttagatgttgctttccttatccaagtatcttgcttctaacctttaatctgaaccccttgtaattgtgtccaaatgttgaactagttgttgttcccaatcaaaagacaccatctttacttccaatcccacactatgttcagccttgaagacattagcatatcataaattaaaacatctttattttctgcaatggagtacaatcgagggaaactatccttaaggtattgatctcccagccaccaagaagtccagaaccaagtttctaagccattaccagccaatctttggatctggtctaaaaaccaatctcttggaaaaccaagaacttattcaattttggctaagccgcgctaccacagggaggatgaagaaaggaatcattgctggtcatgaggaagttgtaggtttccatatttgagaaccaacggattgtaccatatggttgatgaatcagttaataatcgccatttccacttagccaacgggctgagatttaaattgagataagtctttcgcccctggaccccttcacttttatgccgggatacttgttcccaagacacccagcttattttctacgactcagaccatccttgcaaaataaaccttcgttgaatcttcaccaattct

SEQ ID NO: 6991 - DNA, 1000 bp, Glycine max
  Soy_ogl_6380 Gm19:30142801..30143800 Cluster 32
gcaagttcctatacattctgaagcaccaagagaacaagagatttggactctaatagcaggcgtagtgtttgtattgaagagaatctctgacctttgataattgactaattgtctagatgtcttctcataagtgtcaagaatcgattataagatggaagtctccttttcattagccctacaaaacataaaacaatcgtccacaaaataaaaggtgtgagagggttagagttccattacgcgccttgataccatgaatgtcacctcaactctatctttttttttaagaatagaagaaagaaagactctcaatacatattatgaagaggtaagacggcaatggatcaccttgcctaatccctatccctgaagaaattggccctataggattctcattagccaagactgagtattggatagtttcaagaaaagattttatccacccaagccacttttgatgaaaacccatattagacatgacactcaagaggcaaagttttaaaaatgatgtttacaacctctgaagctttcaagagaagatgtgcaagttggctcaggtggtaagcagattcaagattcatatttatcagaaatgagaagtcttcctccgtaacttcaagggtatgtttcggcatgtttgttcccctgttgtttacctaagcagaacgtaattaatgtaagcataaggacaaataagaatattattatattcctaaaagttggattccaaattatttctaattcttaacttgttatagttagcccaacgcttactgaggaaaggttggaaaaataacttgaatttcaaggcattcaaattaattattactcatatggtgaataatttcgaaagcaaaaatgaacattatcaataatggagtgtccttccacaaaagttgcttgctcatttaagatacatttagaaagtaaaggcttgattttgtttgcaagaattttgagatgatcttgtgcagaacattacaaggagcaataggcctgaaag

SEQ ID NO: 6992 - DNA, 1000 bp, Glycine max
  Soy_ogl_6150 Gm18:53234401..53235400 Cluster 32
ctgtagaaccaagattataagttggagaggtagggttctagccaggtgaagtgggattgtacccgggtattgatggactacaaccaacataaggtgaaaactttgcattcgttgaaggagacagccgtaaatttaggctcaataaataactgggagacatcaagccttcatgatatggagttgttccagaagcaggagtcatgccaaaatcaagtcaatgatcacttgagctttctgtcaatatatagttccaagccaatgatcactcaatcctacaaccttcatcttccctctctccgttgtctagccatgctcgatttgcaccacagacatttgcctctcaaaccacacaaacacacgccaacaaactaaccaatcaacaaccagaaatcgcttaacgaacgacaaaccattaaactcgaaagaaagactcaattccaattctacttgagaactttcgaatacaaagtgaacatttatataggatagtgtaaacaaaaaaatatataaaacatggacatcataaattacttcctattatttataaatataaaatagtactatcaatcttattccctttctgaaaatctttacagtttctatttttggttcatcaatacacaatgcttccataatgcttccatgtttctttattatacgtgattatatgaattttcataaaaaaaagaagttataagcttgaatattcaccaataagtatcaaagaagtattcaaaaatatcaaatacttcaccagtaaccagagaagtatccacgaacatttggacacatatctaatatacatacgtgaaacatttgaagtatagtgcctgatagccctttaggaattttttatacaatgtttggatatgtatcatcacatcatatcctatatattttataattttttttaaaaaataatgtatcgaatatgaattgcatccacgcttcatagtgtagggagaattacaatctcgtcaggactgggtattccaaactg

SEQ ID NO: 6993 - DNA, 1063 bp, Glycine max
  Soy_ogl_1641 Gm05:31534701..31535763 Cluster 32
atctagatagtctcagtagtgccgattaacgaggcatcgacaggcacaaatggccctcgatgctcggcaggaaaaacattcttaacccatcatcgataatgtatggccaaattcgcataagacctgattagaaagataggcgatgaactggttgccaatgaaggtacgtagctagtgaggaacgatttcttatgaagtagttgaacctttctatgatcatcgtacgacgtctagtgaccttgttcagttgtagtgcatccaggatcgtcctcgtgggcccaaccagttcatatatccttgtcttaatgtatttcatcatcaacttgtagtcgacaatcaaaaaatgtccatatatccttgttgtaaacacaagattaacataaacataaccttaaaaccaatttaaaaagcttaattaaatttcataaccatggcccgtcccatgaaatgagcaccaaggaataggcttcccaacaataagaatgtgtaggagatgctatcgtgttgagcttttcatccttaagcatggcagcctttcactcctacgtggttgccaaagtttagttttctgcttataagcattcagaaattgtgagtgacactcgtttagaagcgtgatatgaacctacgtcatccccctatagccaactcgtccacaatatataatgtatcatgtgtgtgatatgacatatgtataaaaaaaattaattaaataatacaaaattaatttaaaaaatactaatcggagataagtttccgttgtgtacctaagtaaacagcgaaaacaagtttctaatgtataccaataggtacataacagaaaataatagggaggcagacctttgcttctttactgcaaacttcgttagtgaaaaggaaggataactccacaaagaggaagtgggagactttgagggagaataagaggttgggggagtaggggagagtttgagggtgaagaagaggacttttttcttatccctatacctcatttcttaaaattatgtaccaatataacccgtcctcaaattattcttccaaatgcccctttttttgtttgccg

SEQ ID NO: 6994 - DNA, 1158 bp, Glycine max
  Soy_ogl_2297 Gm07:8657843..8659000 Cluster 32
aatttgaattaatcacctttgccaacctccaaagtgcaaaagttgacacttcctgaagtagtgcatttggagacttaagcaagtcaaccaatagtggaatagctcctctttgtgaaacatgaacctgcgtgaaccacaaagtatggaagtcaataaaaggatttcataacacaggtttatcatataacaagtttgcaacacaaaacttaatccaccttacaatctgaatctgttgcaaattggcatagtaaaaaggctgccattgtttggatctccgaacagcgggaactacattgaaattacgaacttgcaaagattaattgggggagaaaagtacaaaattactaatatggaagtagtggcttactttcagaaaacaataatcatgttcaataaacataccattcatcaataggttgctcacaggaaaaaccatgaccgaagtataatgttacctaagtaaacaaaggacaggttgtaaatccctggctagaagaacttctttcttaatatttggagaagagttgaccagttttctaatcacatcaacctacaaaatgcactaattcagctagtgccagtaatttagaactctgcaagcagtaaactaaaaaatacatgggattctgtgaattcatagaagcgtcttaccgccacgtaatgtattgtaatatcctctgatcgaagcattagtacaagagtgggtaatgccttgcattcaacaatctgcaaaaaaatttcattgttgtaaacaactacaacaacagaatgcatcacaccaatttacagcagaaggtcaactacctgatttttattgtcatcattctgaaaagcaagagttcccaaggccattgcagctggaacctgtaccttggtgtccttgaattcaagcaattcaacaagaggattattttaaggtatgtaaaaaaagagaaaaacctgagaagggtctgaatgatggtattttcataggcaagatggtttattgcatgagctactctgcttagaagatgaataagtggttgagaaatggtactgatcttgtacctccttaacaaatctacaggcaaggctccagcatatataacgagttgcccatgatctggctttttgatgataaagataagaaaaaaaaaattagaattagagttataaaaa

SEQ ID NO: 6995 - DNA, 1200 bp, Glycine max
  Soy_ogl_2733 Gm08:16901101..16902300 Cluster 32
tgtttcctctaccaacatttctatttcaagtcctcctatggcaaatgatccttcattcaatctcatttggtgctggaaggctctcgaatgaatgcaaatctatttatggaagctggccaataatgggttgttaactaatcctagaagatttaagctttgtcttattggtttcgatgtttatgccttttgtaatttagaatttgagacctccttgcattgtatcaaagattgcatctttgccaggcaaacctagattgctttggctaaaaacaatctctctgttcatttctttgttatggatttgcatgattggttatccaaaaatctaaaaggttccaactctagtgttttataggattggggtttagtttttggactggcatgctccctcatttggagaagtcgaaatgagttcatcttctctgctaaacctagttctatcactagcttatgcgttagagtgacttgtgaagttttagaaattcacttatccccttcaatctagtttgactcttcctactccttgccaggttctcaaccccaatctcttcatcttctgggaagcgccactgacatgtttgtataaacttaactgtgatgttgtcgttgctctagtggcaaagctcatgtatggtagggtgttgaaggaccactttggaaccattgtttttgccttttctagcaagattggaacttgctctatcaatattgctgagttgtgggctatagccattaggatcaagattgcttccttaagggtttttgaaagttttatggtcgaatcatattcacagtttgctaccaacctcatccaagttggttgatcttcttctcatgagtacatgcagcctatgtcactcatcaagagtgttgcgaattcgtctggtatttcctcctggattctcgtttactaagaaactaatcaagtcttcctttgcttctttgaaagtttttgctaatgtatcatatgtatctttcccatatggattttaattctatcattctctagtggctctgaccctattttctcaaaaaaaaaaatagtgcgtgtgtttgttcaagattaaagaatgagaagggatcttttttaacatgagaacacatatattttttatatttaattcaaatcttatctatggggtctttaacaaaatggtatattattttcaagattcaaatttataatatacagataaaaaa

SEQ ID NO: 6996 - DNA, 1000 bp, Glycine max
  Soy_ogl_2785 Gm08:22086601..22087600 Cluster 32
attgttttactctaaacatagttgtttttctaacagaacttctccactcaaattgcttttgattatcatggtttgtgagtaatcaagacatcaaatattttatccatagcaaggaaaacggaatccaccacagccaagcctcatgttgcaattaatttaaaaaatatagaaagaaatgttatgagcatgatgaataagaatacaacggtgaaagagatcggagaacaatgcataccctcattcttcttatcagttgctgatggtcatctttagttggattccgaatgagagtagggagtgacagtaaactctctctatacctagcagactgcagattgacacaatagaacaactcttcttctacaccatatatgcgaagctcaagcagctcccctttatcattatacttttctaaactcatcatatctgttccgaaaattccaccatctttggcaatgcactttatattctttcatcacccatatttcagtccttgcacagtctttgaccgagtaacacacattgagacatcccccgatatcgctcaatctacaccattattatatttgtcaagagtaaaatgatcaaacacaggaatctcagataaactcctttgtatcagatcaaaagcaacgacgacgagaatgttattatcgttagagtaaaccagccagtgaagagccccattaaagagtaactcacccaggtgtgctgaggttgccaggataaaaatatggaagattgacatcgactctgttccattcataggagcaaatgaacacaaatctggtataagaattaccatacagagagttactggcaatgcttgcgagcatattgaaagtatggtaattgtctatggggacatgctgacggattccatagaatgagatcatcgtccttgtcgtagtataaaagtataaagcctctgcaagaacccagaatatgaggttgatagtgaaactcgttgtaatgaaagaaattggggtggcgtggggga

SEQ ID NO: 6997 - DNA, 1131 bp, Glycine max
  Soy_ogl_4163 Gm13:8959701..8960831 Cluster 32
aaaccttctatgagcggggaaaatagggaagtttctatacaaactcttcctttatactaatacactcccttttatcaatttttacccaaattaccatgcaaaacacactcccccgatttaactattttctggagagaaaaaaaaaaactctccacctcccacataagtcctccaaaaaacacactcccctcattttttctcttccaaacactccattcttaaccttgcaccgtgacacaaatcaaactctaaaacccgattgaatcaaataacgtctctaccaaattagtttacccaaagaataaccactgcacaaaattgaattctttcaaataaacaacatccggccaaaggatactgtaacattgacataatttgtttgcgtataagcttcttcttcagtgtcgttcttaaattctttattatgctgataaggtcgagttaagtatattttatatatgtgctgcaggaggtacttgggtcataagcatccgcccaaatgcaaagaagttgaacatgttattcacgaacaaaaataataggacgtgggagaaatttgcttcttgacttcgaactttctaggtaggcattataggagaacaaaatgagttgaggctcgacagtggtgagtttaacgagaattcatcctctagtatatgtcaaaactcatcaaagttagagttgaagtattataactcattccaagctccaaagtcgagatcatgttgttgtggttcacatcgaagttaataaagattggtttcttctcagccgctaggcgcgcgtgtgagcgcactgacagtgaagtggattaggaaggtatggttgaagggattgcgtccttgttgtcgttgaaaagaattatactagagggagaggagggagtgtgttagtgtggcgtagactagggataaaaagtgagaagggaagtgcctcagtataaaaagggactgaaaataagaattgcctcgtaggcttagcttatgggctctactttttaagaaaaaaagttaacttattatctttttatcatgatattaataagaaatagttctcatctcaagccacaattagtctttgccaaaatcgtaaactcatataagattatttcttaacaatatcattttcatc

SEQ ID NO: 6998 - DNA, 1000 bp, Glycine max
  Soy_ogl_4180 Gm13:21071401..21072400 Cluster 32
ctatctttgtcacttagttccctttgttttcatccacgatacccacttgaaagtttgtgacctataccaggatgaagtatggcactttgaaagattggtgacgcctattcccctggaaacacaaaaggaaatttagagtatgatccttaatgttgatatggaggatgtcattatttggggagcttttgaagatggcttgtactctatatcatccgcttacaagtgggtttttgctaagcatccattgcctcgcaaccactttcgaaactagtccttagtttggaaggtaagagtgttctaaaatatcaaacactttttttggcttacattttagggaagcctccttgctaaccatttctgtgtctttaggcatatgtcttttgtttcttcttgtaacaagtacaagcaatggacgaaaaccatccttcatctcttacgagattgtcattattccaaagaagtatggcatccactcatcatggacgtagttccacccttctacatcaacacatggatcaattggcttgttaacaaccttagtaacttgcaagggatcctttttgctatcacttgctggacaccctggatgagcaaaaactctcttgatttcaaggtaaaaagtggacaacttggaacatcattagccaaagtcacactgcaccttatgtactgacatagttaattatctccacaagccatctcttggtgaaccagcaagaattttcaaatggacacctccaacttttccttttataaaataaaatactgatggctcatctctttgaaacctgggggtgtcaggatatggcgacattatcagagattattgtggaaattttctcacagccttttcagacaattgtggtactaccaccagtctttggtcgtaattgtttgcgatatatcatggcctctacaaagcttgggaggaagcttatcattatgtgatatgcaaatcagattctacaatggccctacaactcaccaacaaaggcactag

SEQ ID NO: 6999 - DNA, 1275 bp, Glycine max
  Soy_ogl_2246 Gm07:7270701..7271975 Cluster 32
tatttaattgtgttttcaattcaattcatgcaaaccgcaaagctctcaaccccaattgcatttaatgaaatcctcactaatagtagcacccttctaaagctactacattattgaataaaatattaaatgacgtccagacacaacaaaatgtaacctcaaacagaccgaagagttaacaaactcaaatcccaattagattgaactggtaggactttagttatttttgttgtcacaattaaaaattcatatgacagtatattaggaggaaggggtcagagtagtcaaagcaaaaccatgtttgtatctaaatgaaaggtttgaagttagataacattgtattgtgagaggatggactagagtatctttaacgatgcaagtctaatgcgttgcttaccgtaattatttttaacttttttatgagcataatttttttatatatataatttaagcaactttttttcttcattaatgtaacgttgttgtctctgccattttttggtgacatgtgttatatcaactcctactttgaaaataaaagttcaacatataaacaactagtgagactcaagtgcagctttcttcttcttcttcgatgtaaggagcggttccttaaatgaggaggaatctgtccttattaagaacccctcctcagctttatttaatgatattttgagagaagatgtgaatgttcaataagaaaaagtgcttgagcaactgagaataaagttactcttaataatatgccaacgtcacatttataaggataagtagtcaattaacacactacgccacctgttattaataatttggtaacataacaaaaaggtttccttactattattaggtaaaacggaatgtcaattaatcaaagaaatttaggtagaaaattacaactttcattgagagtctaatcaagcctctgctttctccttcaagacggaaacattgatgtttagttattggaaactaagtgaaattcatattatagtttcgtgaaattatgcaattgatcaagaaaaaggtaaattaattaaataatataacagcatccgtcaagagaactaagaacagtaatacttgagataaataaaataacagatccacatataattgctgagatcagaaaatggaacacaatccagatgatgatttgatttcatatcaagcttagtaactctctaagttacaattttacacaacatggtgttcccggccgtcatctagtctcctgataaggagtgaggaataatatgtagcatttaccgtagcaagtgg

SEQ ID NO: 7000 - DNA, 1100 bp, Glycine max
  Soy_ogl_2856 Gm08:41751501..41752600 Cluster 32
agctcgctataggaaataataggcctttttttacaaggtctaaaatacctctgtcgagagcttctttagcaatgcaaaaaagaagggataggggaccccctgcctaatccccctagtgcaagaaaagtagcccaccgagtgctcgttaactatgacaaataacttggctgatatgagaatagtgaggatttaggaactaaacttttgatggaagccaaaagcttcgagcacatccattaagaagtcacaatgaagggtgtcaaaagccttctttatgtcaatctttatagccacattgccccggagtaaattagcagcttctaaggctgtgcaaatgcagtaaaaaatggttcttcctagaatgaaacctctctgattgctggaaacaattttgggagccagcaaagcaagcctctctaccagtattttggtaactatcatgaactaataattagccaaagcaattggcctaaagtcttgaacattattcgttcatggaaatttaggaataagaacattattagaatttaaaaacgacaaaatccaatctttctcaaaaagttgagtagtggatttataaacccttgtggctacgatatccccagttagtgtggtagaagagacctccaaacctgtcgggtccagggacactacctttgtttaaaccaaaaattgcatttttaacttcatccattgatggaatagtagtgagcatgtcatattgttgcaactcaataaaagaagctggtatttctgtcaccacaagtatgccactgtgcccttgacttgtccttttaaaaagaattttgcatgaagagggcctgctggagggtcatctctgcagcttttttagattcaaacaaatgatcataataaccatcagtagcaatttgttgctacaccagatttaaggaattcatagccacattaacatcccccaacatatttttattccagatattgagctccattttcagatttttgagcttttgagccatttcaaacataggacgacccacaagggatctagaccaagagttagacacaatttgatagcacttaggatgatttacccacaatttgatagcacttgggatgat

SEQ ID NO: 7001 - DNA, 1000 bp, Glycine max
  Soy_ogl_4115 Gm12:37246401..37247400 Cluster 32
gcataaattcttccccctatcgagcatttttattttttctaaccctcattattatgtattgagattttttttttatctgaagtgtattgagataactatatcaatttgctagcatttcaataaattaattcctggattttctagcttagctagtttaaccaacgccaacaactctatactaatattaagaaattacatatggcaaggatgtaggacaatatataatcgattatgaaaacaactacccacacatatgcacaagggagccagctcgatggatcagtaggtatacaacaatacatttttcaactctctaaggtcctttccaagttccaataaagcaaggagaagaaaatggaaaatgagcgtacttttcttgttatgcatacctaactttctaaggtgcaggtagctagttttagtacttttaaaaatcatttgagagtttttaaggaatatgctggaattgttaacaacttatttaattttgagaaaaactctcttgcatggacttcatccagccatgcctttttcaggtaactaatttcccctatgcctaattaagtctaaaaggtcctatcttttcatcaaaagaaaaaacaaaaattattctagctagagaagccttctttattgggacacccatattaaaaatgtgccaccaaacatagtaaataaactttaatttccaggaatggcaatggatggctctatataatcatatcaatgtgaatcacgagaaggtgtgttactcgatagaaatttgaaatttcctgtgtaggaaccatatcaatgtgaatcacgagaaggtgtgccacagaatcaatgtatggcattctgtttgtcatttaacagaatttggttgccatgaggaaattgagtatatattgagaaggtagccttatgtgttttttatatgagattaatgcccctgatgtgagtgtaaaaggactttacacacaataaatcacattcttttattttgccaccttacctaata

SEQ ID NO: 7002 - DNA, 1100 bp, Glycine max
  Soy_ogl_6151 Gm18:53254401..53255500 Cluster 32
tcaaggatgaaacactatgatggaagtttgcagacaaatctatggtatccgattcttattgccaacaacctcttgtcaaataccaagattagttaacccatcaacctcttgtgtcacacccgcagaggcctcaccaattgtctgcatatggctagacgttattgaaagtcctcatgttaaatattagaaaacataaactactaaaatgcttggtttgtttggcaacaagttgtataaaatcaagggtcttgctaatcaatgtccttataaggacattggttaatgaactaaaaaaatctttattgtgaaaatcataggagacttaggagactgtaaaaaaatgtcatgaacaacataattttgtgcatcctaataaaaaaaatttctcttaatttcttaaccaatgagctaatgacaccaattagcatttgcctaaaaacaatgaatatgattgacaacatattacatatgtcctttgagagagactatgaacccaactgctaaacctctccttgtgggtggcaaagaagagcttacggtatttagtttagaaataagccagattcaaaagatactatactagataaagcatgtgtatgtgagtaaatacattccaggttcaatgtcaccttagcattatgttcatttgcaatgaaagtgttgggggtgaaagcgtttcactactgaaagaaggtgaaagtgaaagcccctttatgtttgtttcagctgtatttgggatgaaaattcaaaatttacttggacccctgcatcacactttcccctaaaaaatgaggtaaaaggcagtgtaactagagtaaaacaacaaaggttttttggctttccaaaacatacccttgaaatggcagcgtgaagttcgttcagctttgtatttgagaaaggcaatatcgattttgctagcataatcgttttagtaaactaacatcgattttgcatgtaagcataatcgttttagtaaactagcatcgattttacatgtaaggataatcgattatgcttagcttcatcaattatactgacatgaaaatcgattatgccttgtattttttaaaaggtaatcaaagacatataattgattattc

SEQ ID NO: 7003 - DNA, 1008 bp, Glycine max
  Soy_ogl_1885 Gm06:9687301..9688308 Cluster 32
ctagttggaccacctaatttaagtaaaatttctgttataataaacttgcaattaataataaatgttatattttcttcagaaaattatgcatggaatacagcgtgctaaaaaatacttagagaaaaaaaataaaataatagatagagaaaaaaatatataatgagtaatataatgtgatgaaaaagaaaaaaagataatttattgatgaagtgtatgtgatattatatggtatctatatataattacccattttcttctatgttttcttaatttcaagatttttcatttccaacctgcatatgaaccagcaaaacccatgccacctcatcgaaaataataatcccacaagtgagttggaagaatatagattgggtggtttggtcaatagcttggcaaggatatagcagatacgttcgcaggcaaggtgggtcagatgcaatggtgaggattcgtgcatgaacccgtgatatcattctgtctgagcaaatcatccacacgtattttacatatgtatagaatggtgctaaagattcatgaaattgaggcaaaagaaagatcaaatggcaattgcatgcagttacacctaacccaaaatcagattcagtggctgcgtttgaagatgtatagatgtaaaacaagcatatacattgcataattagctgtatagtatggagactgaatctatacatcaaaacataacagaagccttaagaagtggggttggcagaggacaaggtaagggtgggtgcatgtagaattgtgtgttaaatttcccgagtcatttttcacatgtcatttaagaccacttcaaaacatatggcaataatgatatggactaactgctagccagtcatgttattagtcaaccatttaattaaggttaatgtccaggaactaaaatccctctcatgagatagttatcgatttgtaattttataggagttggtaattaaattggttaccgaaatcaacacagcgataattaatatagttcttgaattcctaatt

SEQ ID NO: 7004 - DNA, 1042 bp, Glycine max
  Soy_ogl_124 Gm01:38786730..38787771 Cluster 32
tgaagtataaatagttaaagtgccgataaggaaatataagctgcagggagataaatcaagataaggaaatataagctcatatactcagcaaatccaaaaccaacaaggataattttaagagtaacaaccaaacacattgttggtgagaagagctggacaagatgcttgaagagaataggaggagagtggaagaatctcagagaagagaatataagctggacaattttgccaaagctttaaaatcactatataggtagcaataaatcaggggtcaaatatggcatttttaaaaacttagattgtctaataatttccttaattttggtctatccatcttaaaccaaaaataaaacaaaaagggagtagtgcaaaagtgatacctctattgattttagattcatgtaacttcactttcagatttgtgacattggggtgtccgggactacaaggcaaccataatcgtgactgcatttatccacaatttcccataatcaagcttttaaattgcattcacaattgtgtctttggtttcgtcatgattcttgataccgcaggaaattgcagacaaatgcagttgtggtcacggtgacctaaaaaacctttgatcctgcaacccaagtcacccttgtggaccatttttaaaactctagcctgcaatatcaaggaacaccatgaaaccgcaatcgcaatttaaaaccttgccattcacttaacaactcggcatgcagcctgtaattttgtcaagaaattacattcaaaatcaaaagtgaaagctaaatagcactctagaacagtaacatcagtaataattgttcgaaaaaatgaagaaatgtgacatgagtacggtatgaagctgattaaagcagtacaaaccatgaactaaattggtagacaaatgagagagaacttacagtgaaagaaaaggaaatgaacacgctattgttcgatgatttgcaaaacggtatagtttgatagacagagtcgacaatggagtatgttcagagcactacgactcggagatgaagggcaaatggttacgagg

SEQ ID NO: 7005 - DNA, 1200 bp, Glycine max
  Soy_ogl_141 Gm01:42056701..42057900 Cluster 32
gccatccaaatgatttgtagtcctttactcgctagtttcccggtagccacccttttatctatgcaagagagtcctcaacagcgtttgataaagctaatcaaatcccgaaccatctctccaattcacaccatatcatagaagagtgcttgcaagcaaaaaagagatgtgaaatatcttcactgcattcagcacacactggacaactctcatcgcttattgggatcctcctagaggccatgtaagttctcgtttaaattctatttagaagcattttccaaaccaaagccttcacttttgaaggagctaaaacctccttgaaaacaaaattttcaaacaagtcataattatttgttctctgcatcaagctatggtatgcatcacctactaagtaaacaccttccaaaccttgatcccaccaccattcatctttaacaacagaccgaggtgatataccttttattagggtcgtcgattcttcttttaggctttcctcccatacaaataattgtctctatcacgatagttgccactaccaattacctagtatccacttaccatattctaccactttttgtgtttgctgattagaaatgaaatagagtatgctaaaatgactttttaaatgttgttcccctagccatgtatcattccaaaaggagatttgttcattgcttcccaatatctttcatgcatttttccaaaaccatccttgttcttcctggcacatcttggatttttggtctgaagcgcatatcctctgcaaggctttctttatttttcacaaccttcacccactgtgcttgttcatttacaatggatctccacatccattttgcaaccaaagaatcgttaaaattgaccaaattcctaatcctaagtccacccttatctgttggtttacacatttgctcccagttaaccaagcgctattttcttccttcatcatttgatcccacaaaaagtctttttgcatcttgttgatctagttaataacagccttcggagccacatggaatgagaggaagaagagtaatatcacatatataacttacttaatcaaacatattctgcctccaaatgataaaaaattatgcttcctagatgttaacttcccagcaatattgtctagaaccagctcccatgtttctactctattgaaatttgcccccactggaatgcccaaatatttgaacggtagtt

SEQ ID NO: 7006 - DNA, 1016 bp, Glycine max
  Soy_ogl_2780 Gm08:21587185..21588200 Cluster 32
aacacttcctatttgtctagttagtgtaacatttcagcaaacttcttttcagtaaaccaagaacaaaacaaaaaataaatacctacaaagccttctcttgatattgtctttggttttggctttgacgcagaatgcggtcctcttaaggaaagctggaagtctgagagtttggccatattgttgccatcccaaagaattttataaggtgttacgtcacgatataagatgtttcgcttggagacaccattgtgttgaacagaacctttatatacagtatgaaggtctccgcttccaactatttggtcgtgaaaattgatggcacagatcttctattactgttggatactgttgctgagatgaacttgtatgctttgaacagcagaagctcaaatatttgataagcattatcccaattgtagatgcctgttttgttttcaatcacaactaagattcaagtttcattcttaatagctagctttatctgaactcaatttgatcatgaacatgaatactcatcttttggaatgaaaactaaaaagtatactcatctttgggagatgctttatggctatctaatttagactctaatatatgatgattataatgatgaatttacaaattaagagtaatttaaggagtaccattcatgtgtacaaatttcattagtcattactacattttgtagtttcaggaatgtggtttgacggaataggtgtaaatgtatgtatgattttcctccaacatgaagcaaccaaattgaatttgcttttatcagtttttctttatgacaacaattaaaatttagttaacataaatgaacttgaattagtgcataaaatcaactagctcttggatagtcttttacaatttaattttacatgccttgttaatcagcatccagtttttaatttatatggactagattgttaccagctagtaattaaacattgtatgttctgaaatgttgattgttccggaactgctatagatccagaataggaggactatagtaaaca

SEQ ID NO: 7007 - DNA, 1143 bp, Glycine max
  Soy_ogl_3084 Gm09:29862058..29863200 Cluster 32
gcgacattaagattccagaagctcatgtgtagatacttttattccaacatcatgattttgcttttctagatatcaatagaatttaacccaaatacattgacagtcaaatgttttttacactgtcattcaataatagattgtcatataagattttttatttttttaaatatttttctaattggatgacagtgtaaaaatatttaaactaatgtatgaaacttcagctcaacattttttgtttccataaatttcatatggagaagaacagacatctcactctctgcctatccctctctccgcctgtctcttcctcttgtccccttatcttttcatttggagcagaacaggcaacttaccccctcttttctttcaattgatatctaaaccaaaattagttacacaaatacttcatttatagaaattaatgacttctccaaagttttttaaaacaaaaaataaatcttagtatctaatgaaaacattttggaatgtgataatccaaaaagaggagttgctttagtggccattttggggagtgaaaacctagaaatacttggcatagcaacaaatagaatagtaattcaagttgtttgctgtcatttttctaaattattggtaaaagtgacagggtgattacgccacaaaaataccttgcgatttggtgacaagcaacatattcagggattccttcctaagacaagatatggcaattctaaagggatcctgacaattgacaaacatattgatccaaataaaggaactgaaaccaaacatgaaatgttgaggaagtaattccaagtaatacatgaatgacctatgataagacaataagagagtacctagtttgattctcccacggataataaaatcaaaatcttaaaacacttaaataggctaactaaaactctttcactttggttttgaaagataatcaagcaagcacatgaaccaatcgaataataatatagcctatctaaaatcttgaaaatcatatctgatcatgcaatatgcatccgaaacatccactccagatatccataattactgagaagttcatatcaactactaatttggccaaacattacaaattattaactaagacttccccagagacttatgcataaaaaaatgtataaggcatga

SEQ ID NO: 7008 - DNA, 1140 bp, Glycine max
  Soy_ogl_3875 Gm11:17950861..17952000 Cluster 32
tgacatctccaagtgaaacttgtcctgtttgcaactgtttcattactcccatttctgacaattttttttaaaacaaccataacaacaaaataatggaatagtaaaaatatacaggtgaattgtcttttccatgtcctgttaagttatatattgaggaaacaattacattttgaatgaactagaacatgcaaagcagaaaaggtactttattccaactagactgctaatagccttggtgtccggttacaatagtaagttgcatttgtgctattcatgttaatagccttggtgtagtaattgactgccttattctacagcctgcctgattaccagcacagctaggtagatttcaaaagtacaccagacaagcaaaggtaggaacattaattaattataggaagaaactctgaaaaaatatcccctatatctttgacaatttcctcgtactaatgtcaagcatgcctaagaatagtacccagagttgggaaggagcaccactgtaagttaacatccatagcaaggcctttgctctgattttacaagaaaacaaagctgattccattaactatcaatagagaagctaataataaagattagtttgatgagttaaccaccttttaacaagtatctgttgcccaagctatagcagatatgaccaatggatataaaagccatattaatcatagtttaatatatattgaatgatataaatatattagaatatatctaaatataagtctactataaaataataaccagcgcttttgctttatgggttaaaattattatctcgctttattgcatgttttttcattggtaattccatccacttaaaaataataataaaaagggaactttgtttaacttggagtatagtttttatagcttcaatgcaaggtggtgacgaacttgaaaaagaaaacaaaaagtaacttgttttctagttttcattggctattacataataaaaatgaaatattaattaatggatgaagtaaccattatatgcataagaataatgtacacctcttactgccttggagccccattggtgtcctcgggggcaggtgagaaatcgacagcacaaggaatggtcataaattgtattaaaataaataaagatcactaacagcaggaaaa

SEQ ID NO: 7009 - DNA, 1000 bp, Glycine max
  Soy_ogl_4338 Gm13:29123501..29124500 Cluster 32
cataactcagagtaagaggaatgcacaatcaaaatcaatggaatgaatggttaaggtggtaagaggcattcatatatcaatatctacaactaaagaacattgagtccccaaaaagaatcatcttcaaagaactcattgtgcaccttgctactatccaaaaagactaaacaaaagggaaatcatctcttggtaaccataatgatgtaccacaaacccatacaaaagaagaaaaaaaatgaagggagtgaggtgatttaatttccaaatcactgccacaaataaatttgaatgtagcctattaacctacgtaatcaatcgcatcaagagatcaactaatatactaaatgcaagggtaccaaagttttgacttaagttatcatggattaatatacaagacttgtatggattcacaccccacttgatgatgatcatcaatacatcactagttgtaggaagtgattgggagcctgtatcccccttataatagtacaatcataatcattttctctagaataaaactaaaaggcttctcttaggggaatacgcttagccaatcctggtgatcgatgctaagttggtgttagggttatcaagttggtttatgtgattgtcccaatgtaaggttgttattctaaccttcgggattccaacaattaactcaatatcgtaccctttagaccttatcggtggtccctaccttcgtcccatagtataccaagatatgacttccaaaacacactagctagaatagatgccatcaatacatggtttatcatcaatcaccttaacatatgccatcagtttcaaatgaactttactgtcttttggaaactaatttttgatactcgtcaaaattgcattcgcaaacaccataagaagaaaaaatgaaatgagaaaatgttttaaacttctgtctcttgcttcttctttttttccttttctttttgtaagaaattttgtcagcagatgtttgtctcatatttaattttcttttatgacc

SEQ ID NO: 7010 - DNA, 1000 bp, Glycine max
  Soy_ogl_5332 Gm16:6936901..6937900 Cluster 32
ttatctataccacaccttgttgctgctttggaaccggggaagaagattactatatatgccttggcaggatgttgataaaaaaattggaggaagcaggtttaatagtatataacttcagtccctttgagaatggattatattgtgatatttgcatttgctgagagtatgttgtttaatttgctgtccaaggcatttagattatctcctatgtacttatgctcattctgattatgctctttaggctgttgattcaattatcgtatgtgaaattgatgcttgtcattcaatttataggtccgggaaatcaaggttccagatcaaagccagttggaagtgtaaattttttgagtcaaacatgtatacaggtgtgatgatgttgagttctttagatcaaagccagttgcatattttgttctcaccacacctggaaggtgttttttttattctatttggaaacatcatatatgacttgagcggtataacatgtaattgtcaaatgtatacttttcatgagactcccaatgcataattatgagattctaagttgcccctgttgtattatgtggcaaaatgttaggagtgctaagctgctgctttgattgatatgccctcaaataatgttcagtgtaagagagaataactacagttcccttgcctctaggtcaaggtggacagagttgcttagccattgtgttttttgttgtttcccaaaactattttataatataatttctatttctaaaaaatgttttccggaacaagaaaaaaaaattgtcaacatgttagtgaaaatagtttttaaaggaaagagacacaatttaaggtatttggggggtgagtatgaaattgattttgaataaaagttgattttggttaaagttggttcttaaggaaaataatttctatttgagtgtttatattctaaaaaaaagtttgatgtaaatttaatattttaaccaaaaacaagatactttttcaacaatttatatttgaatgtgtt

SEQ ID NO: 7011 - DNA, 1010 bp, Glycine max
  Soy_ogl_6014 Gm18:9964591..9965600 Cluster 32
gatgaagaatctctctttttcattacatcacttatcacatttattattttttctcagtacttttcctcttttctttctgcgtctttactttccaccgcaatccacctcaaaatgaggtagacgaatatccttagtctctacaatttcaacttgatcattttttcgtctactcaaaaccaaggtgtctaagaatgatatctttatcacttgtactaaattgctatgtaaaagggacagtgcacccgaaaatacacgcgaagacttcggatttggatctgcttaagtgcaatttcatgcctgtttgatgaaggtcacatagttcatatttttatttggatttgtgttcaatagcttttttgggtttccttgtttcttgcattcagttgctagtgctaccatggacactgtacaaattacttttgaaatctgaattgatgtcttcgctgaataataaagtaatcttctgtttgttatttatatacaacctatatcaatcattaattttcccatgcatcaataatcaataattaaaatacttttccttctatagtaattgctcatcctggccaattggtttaattctttttaatagtattcttttacatgaattttattcagaaaatgtgcatatcaaatcaaaagtttgaaatctgtcattaattaatttacttcacaggtcacattataattttaagaaactttaaaaaaaaaatacacaaaataaatgataaagtcatatatatagaaaaacataaaaaaagaaaaaagaaccaacacttgatgattgttttttttggtaggcacttaatgattgttatgggcaccaatatggtttctattttcaagatgcatgtatcttccctccaactatagtacagtacaataataaaactttctcagtgagttttagaatctttatgggacaccattcattttcgttggattcatataatgagtctacggttccggaaggaacttagattttgtaagaagtctgaaaatcccttacc

SEQ ID NO: 7012 - DNA, 1000 bp, Glycine max
  Soy_ogl_1802 Gm06:6422201..6423200 Cluster 32
atttgttgtttgaatgcaataattatataacctgattaaactgtaggatatgcattatgctgcaaccccaagaatgttcccctctattgaagaatgcaactcacgttcacccttttaatctagaagttaacgggtcttgcccacactatatatagctgaattcaaccactagaagttaggtaagcacatcaaagaaaatttctggctttaggtcttttcttgtcacatcagggaagattatatgtggctgtatactcgaaatccagttccttcttggatcccaaaattcatacagtgccaatagttgttgtctgtatgtacgtatgaacctgagacttgcactttgccttgatatatagtgcattatacgatagcctgaataggccattattctttaacctacaatgtgaaagtggtatgagttgtatgcatttccctataatttgtcttgctttttctatcaattatttttcggcgtttgcatgttaatttatgagatatattgaacttttaggcttttttatcgtatatatatgctcaaagaagaacaattaacatgtcccgccatataaaatgcatgaagaagttattgtgacacactctagctgatatatggaaactaacacagacttggaaatcaatgaaatcatagactccgtcacaggaggcatctaaggacccctgcaataatttctatacacagctgattttcttgatgggagtgtcgtactgagttatatctgcaaattcttccactttgcattgtccatgtagacatcttgatctatattctgagcaatgagcatcatcgtaaatgtaggctaatgttgatgattcgggaaactttaaaaaatttcatgatcatggtcattgcgaatttctgctagttactactacgaataacaaatagtaattaaccattttatttgattcggaatgtttacacacacaaaaaaaagaagggaatatatacattcttgtggtcatggatgaagtattt

SEQ ID NO: 7013 - DNA, 1000 bp, Glycine max
  Soy_ogl_1911 Gm06:11877501..11878500 Cluster 32
actagataatttttacgttaagaaaagaattaatctccctctattggttaaaaaatatctttgatgaacaaaaatttcaagcccgtttttctaatttctctcttgaatccttggtccatgactgaatatgctgaccatggcatgaaatttgatagttttcttttttttttttacagacatgaaatttgatagttaagaagataaaatccacgattaaaaaatcccataatttggataactatcaaccaattcaatttcatgcattttgaatgtaatagtcatacataggaaacctttactccattccggagggtgttctcagatactgaaacatttataaaatagttttgtgtgattattcattgtataattcctctcttttctgctctcacaattccaccaaattcctatatttgaccaatttacattccaggcttgataatattgtccaagcggtaattttttggcaagcaagatgacgattttgaccatgcttgccgagataatggttgtaattgtatggattttttgatgcaaattgaacatcttggtgcggatcagcacaaacctttgggaacataacctttgattcttacatcctgatatagtaagctggaggaaaagcttgtgtttttacctcagaaactgaaaaaaaaaatgtgacaaacaaagaaatggataaatcatgaatgcttgtgcggttgcagacttgcaggcaatgctaagctgagttacaaatttgtttaattagctttttttaagtaagaattttaagatcattgaaaaggagattctaatggtttggactttcgacaaattgtttttggttcccgaatgttggcagcaaaggcagttgcttcctgcatccctcgatttattatttgcacatttttcaaccattttttcgactaaagttgaacttcttcatccccataattgtgtacctctcacaacagtgtgcattcccctatgtatctcctccgatgaagttattatttga

SEQ ID NO: 7014 - DNA, 1104 bp, Glycine max
  Soy_ogl_3093 Gm09:31761190..31762293 Cluster 32
tcactttgtttaggcattaaaagttcaacgatagtacattttattttactaaaataaagttacacattttaatatattttttcttttcttaacatttctaaaaccaagttctgcataatggtcccctatgttaatgtcaacgactcctatctcaaagttgttgacctttgcccacgatggaaattggaatctattgacagaatttatgtcccctgctgacccatattaatgagcttatccttattggcctgaaagttccacatggcttagaaggaaaagatgccattgcctggctcattcctagtggaccttttagaggactctagggtgccttagttttctttctttgctttttcatgcttgtattcctactctactaacaaaatattcgaatgcaaaactaaatttgcacttatacatcgaacacattattatattagcatttgagttgtcaacatatccctcctgctttaagaatcatggaaaatcagaggtgatgtagctgtataataactagttttggaattttccaaaattacgattctctctctgttaactacagacattttagttttgtcttccatgattccatcccttaactagacatcttttacatgtgtgatagatttttccttgcatcccatgatggactttatttacatgcatgtttgatgttagacagtagtgcacgggattttgtaagggatttgaattcttctattttttaaaaacaaaaaaacaaaaaactagaagagaattaatgataagatctaaagtagagcacaagatgtgccaagtttacgaaaaagaacaaaacagttgtgaggttcacaaggccacaaaaggatacgtgatagaaagagatactcgattttgtaaatgacgaaaaaaaaaacttgtcattaattgtttaagggtttttttttgtaagggatgtaattaaggaataacgattttgtaaatgaagaaaacagaaaaactctcattaattttgtaaggagtttgtattttttgtgtgtgtgtaaggaatttgtattcttctttcttatataattactgtggagaaaagaataaaacttgtcattatttgtgtaaggttcacaa

SEQ ID NO: 7015 - DNA, 1000 bp, Glycine max
  Soy_ogl_4202 Gm13:22157501..22158500 Cluster 32
aatggcaattacgatatgaattttgcattcaaagttcgaagcctcgatgaccctaatttgaattcaagatgaaatctttattccatgatcttgaattctctatgaattcagaatgatcctcggtgaccctagcctaatggcgactgcaatgtgaatttttattaatatttttgaagtgggaatgagtctcggtgacagcttaatgacagttacgattatgatttttttttaattcataatttttaagcaggattgaagcctctctgaccctgaatacgattgcaagataaagactgatggaatattcagcccataatgatcctaaattcatattttgattcgttgtgttaaatgaggatggttggaacgagtacatatgaacccaagcataactgtgatggtcctaaatgctattataattatggaaacatgaatctaagcatgtgccatgacgcctgaccctgaaagcaatttcgtattgttaaattgggacgaaatgcattgtgccttagtgattctgaatgcaacctgtgcttgggtgtgcttgagtttatgatgataaaaaatacaatagtacaatgcatctgagggtagtccttttgatggccctaatgcatgtatgtgccttagtgattctgaatgcaacctttgcttgggtgtgcttgagtttttgatgatgacaaatacaatagtacaatgaatctgagtgtagtccttttgatggccctaatgcaagtatgttccttagtgattttttatgcacacatgaatctaagcatgtgccttgatgactaacccttaaagccattctaaatgggatagaattcactgtgccttggtgactctaaatgcaattgtgactggatcttttatgatgctaaatacaattctacaatgaatctaagcacaatcctcaatggttctgaaatgcaattacaatatgaaagcaaacatgaatctaagcatatgcctcgaaggctggcccttaaagtatataaaa

SEQ ID NO: 7016 - DNA, 1000 bp, Glycine max
  Soy_ogl_4255 Gm13:24863201..24864200 Cluster 32
tgtcatggctatatttaattcaaatgcataaaaaccaaatacactacagtcaaactaatatttgaaattgcccaaaaagaattgatataatattttataatggtggtatagtatttccaaacgaaggtcgccttttctttttggaaaaacaaacaactcttgaaaataaccaccagccccaatttggtcttttgaagaaaaaagtgactatataatctcttcaattataaatttgggatacttcaactcttagtcattttccttcattttcaaaaactgaatttactatttatttggtcttttttcttttcaaccaaattaatcttatttacgcaggagaagtagttagaacataattacatgaatactcaataaagattgacccagttatatagaattgaactcatattctataagaactcgtgagttcaaattccgtaacttatgtgataattttgttattagtgacctaaaaagtcacaaaaatttaactcaacttttttaaccacaaaaaataaatttataccaaatatactacatgcgtttcaacttgtaagtttaggctgtttagccccttgaccctttcctcttgctcctatagctctatgcatggataaatcaataatttggatgttttgaaattataatataaaatgaagtggagagtaatggcacattggagggtgagatgggtgctgcagttaaactacaccacttctcccatccttccatggagcatcatcatccacccaccaattaatatgtgtgatttgtaatgtactaatgcatgccccccaaaaagtgagggaaatgtttcagctttttttattgttggttgttacattacaatgacactatgctattggtccattggcccattgaactagcaaaagcaaaaagaaagataaagctgcagaaattgaaggcgagattggcgctccaaatctaaaaacatttgccccaataactcactatactgagtcggcaagacttgaaaaag

SEQ ID NO: 7017 - DNA, 1000 bp, Glycine max
  Soy_ogl_5716 Gm17:33575001..33576000 Cluster 32
tgataagtcctgattcacttacgtataaagcattagtcaacataaattatacatttgttttcatcaaaacctagatatgagtggatctttcaatgatggaccgtctagttctaacaattaggagttgccttcaccatggttttagtcagcagaggatagtccatattttctatggagggttgtcctctcacaagactaaccttgatgcttcatgtggggggtaacctgatgttaaaacccccagttgttgccatcaaaatcattgaggatatgagttccaatcccaaaataactaaagggatatgtggattatgaccaatcaatactaggtggagacagatgcgtctaatacagatcttggataaaaaaattaagtgttgtctaagcaaattgaaacgataatgaaggcatagtcttgggttgtagtttctacacctccttaccacacttgtgataagtgtggatatgtccatgctccaaaagaatgcatagtgagtgatgagttggcctaagctatggatgagattaactttgtgggtggtaagagaatggatatgagcagtactccaacaactacaatcaggggcaaaaattcaggtaggttcaaaatcagaacttgcgtaggcctccacacttgcaaaatcaggggtttagacaagataagaggtgacctactttgcaagacatgttgatgaaattcatgactcaaatttatagcagatgaagcacatggagacccggctctacaacatggaagttatcttgtctcaagcttttggaactcttccttctcaaactgaaagtaatcctaagaagaatgaggtgaatgttgtgagtactaggagtagaaggcctatgacagagttgaagaagaaaggagcaaaccacttcccaccaaaaaaagagattcttactaaagggagtctagatgcagaaaaagaaggtaacaaataggtactgacacctcctcaagtaagtattaccttctcctagagagtgc

SEQ ID NO: 7018 - DNA, 1000 bp, Glycine max
  Soy_ogl_6809 Gm20:37426301..37427300 Cluster 32
gtgcttgatgcatggtgcatgatgtgatgatccaactttttttatataaaaaaactttatcaacattcttgaatgattcggattcctttacattgctcatgcatatatgtggtgcaggagagcgtgcttgtacaagttcacaaattaaggtgataaaactaaaggagggattcaagaaaagcactgtgctattgaagggaaatcctataaaattaaaatgacttttcatctcattatctttgaagagataatgccataagagtattccattaaacagcagcctaaagcacagggaggttggccacatgatgagcatcatcctgattcgctgctgctacattaggaaattcttaaaattataagcctccattgagtacttcagaccatcgatcttaaagatccaacatacctaacctaggtttcttctaaaaactatttttaatttaactaaactgatagctaaattcaacaaggcaaacacaaaggcacaaaaataggcggataggggtaacatatgaattactaaacgctgggttcaaccattgttcaatcatggaaggaaaataaacgtttcacggacaggggtacttacctttgacggaaacttcactgatcaacttctccgttgttgcttcgcagagattgaagacacaaaggcacagtgcgggtgacttcgagggtcactgtcaacataaaggcacaataagcattgagggagtatagataatgaaactcgaagacaaacagaaaattaaggggcttttcagggagtagacgtacgactagcttgaacaacgatgaacggtgaacacaatatcaaagaacctagctaggttacgcgcgtgcgactgagacgaaggtatcacgagtaattaaatcataaattttaaaagcttattcaaagatggtcattatgaaaagagtgtctttatatgaccatatgaactacgaccatcttaacaccctcgtagttgtacatgcaatattgcttattaaaggc

SEQ ID NO: 7019 - protein, 7 aa, Artificial Sequence
  Description of Artificial Sequence: Synthetic peptide
QSANRTK

SEQ ID NO: 7020 - protein, 7 aa, Artificial Sequence
  Description of Artificial Sequence: Synthetic peptide
HRSSLRR

SEQ ID NO: 7021 - protein, 7 aa, Artificial Sequence
  Description of Artificial Sequence: Synthetic peptide
QSANRTK

SEQ ID NO: 7022 - protein, 7 aa, Artificial Sequence
  Description of Artificial Sequence: Synthetic peptide
DSSDRKK

SEQ ID NO: 7023 - protein, 7 aa, Artificial Sequence
  Description of Artificial Sequence: Synthetic peptide
DRSNRTT

SEQ ID NO: 7024 - protein, 7 aa, Artificial Sequence
  Description of Artificial Sequence: Synthetic peptide
DNSNRIK

SEQ ID NO: 7025 - protein, 7 aa, Artificial Sequence
  Description of Artificial Sequence: Synthetic peptide
RSDNLSV

SEQ ID NO: 7026 - protein, 7 aa, Artificial Sequence
  Description of Artificial Sequence: Synthetic peptide
QKATRIN

SEQ ID NO: 7027 - protein, 7 aa, Artificial Sequence
  Description of Artificial Sequence: Synthetic peptide
RSDHLSE

SEQ ID NO: 7028 - protein, 7 aa, Artificial Sequence
  Description of Artificial Sequence: Synthetic peptide
RNDNRKN

SEQ ID NO: 7029 - protein, 7 aa, Artificial Sequence
  Description of Artificial Sequence: Synthetic peptide
DRSNRTT

SEQ ID NO: 7030 - protein, 7 aa, Artificial Sequence
  Description of Artificial Sequence: Synthetic peptide
RKYYLAK

SEQ ID NO: 7031 - protein, 7 aa, Artificial Sequence
  Description of Artificial Sequence: Synthetic peptide
DRSNRTT

SEQ ID NO: 7032 - protein, 7 aa, Artificial Sequence
  Description of Artificial Sequence: Synthetic peptide
QSAHRIT

SEQ ID NO: 7033 - protein, 7 aa, Artificial Sequence
  Description of Artificial Sequence: Synthetic peptide
HAQGLRH

SEQ ID NO: 7034 - protein, 7 aa, Artificial Sequence
  Description of Artificial Sequence: Synthetic peptide
QSGHLSR

SEQ ID NO: 7035 - protein, 7 aa, Artificial Sequence
  Description of Artificial Sequence: Synthetic peptide
QSGHLSR

SEQ ID NO: 7036 - protein, 7 aa, Artificial Sequence
  Description of Artificial Sequence: Synthetic peptide
QSGSLTR

SEQ ID NO: 7037 - protein, 7 aa, Artificial Sequence
  Description of Artificial Sequence: Synthetic peptide
RLDWLPM

SEQ ID NO: 7038 - protein, 7 aa, Artificial Sequence
  Description of Artificial Sequence: Synthetic peptide
RPYTLRL

SEQ ID NO: 7039 - protein, 7 aa, Artificial Sequence
  Description of Artificial Sequence: Synthetic peptide
DNSNRIK

SEQ ID NO: 7040 - protein, 7 aa, Artificial Sequence
  Description of Artificial Sequence: Synthetic peptide
TSGNLTR

SEQ ID NO: 7041 - protein, 7 aa, Artificial Sequence
  Description of Artificial Sequence: Synthetic peptide
TSGNLTR

SEQ ID NO: 7042 - protein, 7 aa, Artificial Sequence
  Description of Artificial Sequence: Synthetic peptide
QSGDLTR

SEQ ID NO: 7043 - protein, 7 aa, Artificial Sequence
  Description of Artificial Sequence: Synthetic peptide
HKWVLRQ

SEQ ID NO: 7044 - protein, 7 aa, Artificial Sequence
  Description of Artificial Sequence: Synthetic peptide
QSGHLAR

SEQ ID NO: 7045 - protein, 7 aa, Artificial Sequence
  Description of Artificial Sequence: Synthetic peptide
TSSNRKT

SEQ ID NO: 7046 - protein, 7 aa, Artificial Sequence
  Description of Artificial Sequence: Synthetic peptide
DSSDRKK

SEQ ID NO: 7047 - protein, 7 aa, Artificial Sequence
  Description of Artificial Sequence: Synthetic peptide
QSGNLAR

SEQ ID NO: 7048 - protein, 7 aa, Artificial Sequence
  Description of Artificial Sequence: Synthetic peptide
HNSSLKD

SEQ ID NO: 7049 - protein, 7 aa, Artificial Sequence
  Description of Artificial Sequence: Synthetic peptide
TSGSLSR

SEQ ID NO: 7050 - protein, 7 aa, Artificial Sequence
  Description of Artificial Sequence: Synthetic peptide
QLNNLKT

SEQ ID NO: 7051 - protein, 7 aa, Artificial Sequence
  Description of Artificial Sequence: Synthetic peptide
QSADRTK

SEQ ID NO: 7052 - protein, 7 aa, Artificial Sequence
  Description of Artificial Sequence: Synthetic peptide
DNSNRIK

SEQ ID NO: 7053 - protein, 7 aa, Artificial Sequence
  Description of Artificial Sequence: Synthetic peptide
TSGSLSR

SEQ ID NO: 7054 - protein, 7 aa, Artificial Sequence
  Description of Artificial Sequence: Synthetic peptide
QSGDLTR

SEQ ID NO: 7055 - protein, 7 aa, Artificial Sequence
  Description of Artificial Sequence: Synthetic peptide
QSANRTK

SEQ ID NO: 7056 - protein, 7 aa, Artificial Sequence
  Description of Artificial Sequence: Synthetic peptide
DRSNRTT

SEQ ID NO: 7057 - protein, 7 aa, Artificial Sequence
  Description of Artificial Sequence: Synthetic peptide
QSGDLTR

SEQ ID NO: 7058 - protein, 7 aa, Artificial Sequence
  Description of Artificial Sequence: Synthetic peptide
HRSSLLN

SEQ ID NO: 7059 - protein, 7 aa, Artificial Sequence
  Description of Artificial Sequence: Synthetic peptide
IDHGRYR

SEQ ID NO: 7060 - protein, 7 aa, Artificial Sequence
  Description of Artificial Sequence: Synthetic peptide
DRSNLTR

SEQ ID NO: 7061 - protein, 7 aa, Artificial Sequence
  Description of Artificial Sequence: Synthetic peptide
QSGDLTR

SEQ ID NO: 7062 - protein, 7 aa, Artificial Sequence
  Description of Artificial Sequence: Synthetic peptide
QSGDLTR

SEQ ID NO: 7063 - protein, 7 aa, Artificial Sequence
  Description of Artificial Sequence: Synthetic peptide
QRNARTL

SEQ ID NO: 7064 - protein, 7 aa, Artificial Sequence
  Description of Artificial Sequence: Synthetic peptide
TSGNLTR

SEQ ID NO: 7065 - protein, 7 aa, Artificial Sequence
  Description of Artificial Sequence: Synthetic peptide
DRTGLRS

SEQ ID NO: 7066 - protein, 7 aa, Artificial Sequence
  Description of Artificial Sequence: Synthetic peptide
SQYTLRD

SEQ ID NO: 7067 - protein, 7 aa, Artificial Sequence
  Description of Artificial Sequence: Synthetic peptide
TSGHLSR

SEQ ID NO: 7068 - protein, 7 aa, Artificial Sequence
  Description of Artificial Sequence: Synthetic peptide
RSDHLSE

SEQ ID NO: 7069 - protein, 7 aa, Artificial Sequence
  Description of Artificial Sequence: Synthetic peptide
QSASRKN

SEQ ID NO: 7070 - protein, 7 aa, Artificial Sequence
  Description of Artificial Sequence: Synthetic peptide
TNQNRIT

SEQ ID NO: 7071 - protein, 7 aa, Artificial Sequence
  Description of Artificial Sequence: Synthetic peptide
HSNARKT

SEQ ID NO: 7072 - protein, 7 aa, Artificial Sequence
  Description of Artificial Sequence: Synthetic peptide
QSADRTK

SEQ ID NO: 7073 - protein, 7 aa, Artificial Sequence
  Description of Artificial Sequence: Synthetic peptide
DNSNRIK

SEQ ID NO: 7074 - protein, 7 aa, Artificial Sequence
  Description of Artificial Sequence: Synthetic peptide
RSDALTQ

SEQ ID NO: 7075 - protein, 7 aa, Artificial Sequence
  Description of Artificial Sequence: Synthetic peptide
TSGNLTR

SEQ ID NO: 7076 - protein, 7 aa, Artificial Sequence
  Description of Artificial Sequence: Synthetic peptide
QSNQLRQ

SEQ ID NO: 7077 - protein, 7 aa, Artificial Sequence
  Description of Artificial Sequence: Synthetic peptide
QSGNLAR

SEQ ID NO: 7078 - protein, 7 aa, Artificial Sequence
  Description of Artificial Sequence: Synthetic peptide
RQEHRVA

SEQ ID NO: 7079 - protein, 7 aa, Artificial Sequence
  Description of Artificial Sequence: Synthetic peptide
QSGALAR

SEQ ID NO: 7080 - protein, 7 aa, Artificial Sequence
  Description of Artificial Sequence: Synthetic peptide
QSGHLSR

SEQ ID NO: 7081 - protein, 7 aa, Artificial Sequence
  Description of Artificial Sequence: Synthetic peptide
QSGSLTR

SEQ ID NO: 7082 - protein, 7 aa, Artificial Sequence
  Description of Artificial Sequence: Synthetic peptide
WRSCRSA

SEQ ID NO: 7083 - protein, 7 aa, Artificial Sequence
  Description of Artificial Sequence: Synthetic peptide
QSGNLAR

SEQ ID NO: 7084 - protein, 7 aa, Artificial Sequence
  Description of Artificial Sequence: Synthetic peptide
WRISLAA

SEQ ID NO: 7085 - protein, 7 aa, Artificial Sequence
  Description of Artificial Sequence: Synthetic peptide
QKHHLGD

SEQ ID NO: 7086 - protein, 7 aa, Artificial Sequence
  Description of Artificial Sequence: Synthetic peptide
RSADLSR

SEQ ID NO: 7087 - protein, 7 aa, Artificial Sequence
  Description of Artificial Sequence: Synthetic peptide
DRSNRTT

SEQ ID NO: 7088 - protein, 7 aa, Artificial Sequence
  Description of Artificial Sequence: Synthetic peptide
QSANRTK

SEQ ID NO: 7089 - protein, 7 aa, Artificial Sequence
  Description of Artificial Sequence: Synthetic peptide
QSANRTK

SEQ ID NO: 7090 - protein, 7 aa, Artificial Sequence
  Description of Artificial Sequence: Synthetic peptide
DRSNRTT

SEQ ID NO: 7091 - protein, 7 aa, Artificial Sequence
  Description of Artificial Sequence: Synthetic peptide
QSGNLAR

SEQ ID NO: 7092 - protein, 7 aa, Artificial Sequence
  Description of Artificial Sequence: Synthetic peptide
QSGNLAR

SEQ ID NO: 7093 - protein, 7 aa, Artificial Sequence
  Description of Artificial Sequence: Synthetic peptide
TSGNLTR

SEQ ID NO: 7094 - protein, 7 aa, Artificial Sequence
  Description of Artificial Sequence: Synthetic peptide
DRSNRTT

SEQ ID NO: 7095 - protein, 7 aa, Artificial Sequence
  Description of Artificial Sequence: Synthetic peptide
QNATRIN

SEQ ID NO: 7096 - protein, 7 aa, Artificial Sequence
  Description of Artificial Sequence: Synthetic peptide
TSSNRKT

SEQ ID NO: 7097 - protein, 7 aa, Artificial Sequence
  Description of Artificial Sequence: Synthetic peptide
QSGHLSR

SEQ ID NO: 7098 - protein, 7 aa, Artificial Sequence
  Description of Artificial Sequence: Synthetic peptide
DSSTRKT

SEQ ID NO: 7099 - protein, 7 aa, Artificial Sequence
  Description of Artificial Sequence: Synthetic peptide
QSGNLAR

SEQ ID NO: 7100 - protein, 7 aa, Artificial Sequence
  Description of Artificial Sequence: Synthetic peptide
RSDVLST

SEQ ID NO: 7101 - protein, 7 aa, Artificial Sequence
  Description of Artificial Sequence: Synthetic peptide
QSGPLTQ

SEQ ID NO: 7102 - protein, 7 aa, Artificial Sequence
  Description of Artificial Sequence: Synthetic peptide
QSGNLAR

SEQ ID NO: 7103 - protein, 7 aa, Artificial Sequence
  Description of Artificial Sequence: Synthetic peptide
DKSCLPT

SEQ ID NO: 7104 - protein, 7 aa, Artificial Sequence
  Description of Artificial Sequence: Synthetic peptide
WELNRRT

SEQ ID NO: 7105 - protein, 7 aa, Artificial Sequence
  Description of Artificial Sequence: Synthetic peptide
TSGNLTR

SEQ ID NO: 7106 - protein, 7 aa, Artificial Sequence
  Description of Artificial Sequence: Synthetic peptide
DRSNLTR

SEQ ID NO: 7107 - protein, 7 aa, Artificial Sequence
  Description of Artificial Sequence: Synthetic peptide
DRSDLSR

SEQ ID NO: 7108 - protein, 7 aa, Artificial Sequence
  Description of Artificial Sequence: Synthetic peptide
RREHLRA

SEQ ID NO: 7109 - protein, 7 aa, Artificial Sequence
  Description of Artificial Sequence: Synthetic peptide
RSDNLAR

SEQ ID NO: 7110 - protein, 7 aa, Artificial Sequence
  Description of Artificial Sequence: Synthetic peptide
QWNYRGS

SEQ ID NO: 7111 - protein, 7 aa, Artificial Sequence
  Description of Artificial Sequence: Synthetic peptide
RSHSLLR

SEQ ID NO: 7112 - protein, 7 aa, Artificial Sequence
  Description of Artificial Sequence: Synthetic peptide
RRDTLLD

SEQ ID NO: 7113 - protein, 7 aa, Artificial Sequence
  Description of Artificial Sequence: Synthetic peptide
QSGDLTR

SEQ ID NO: 7114 - protein, 7 aa, Artificial Sequence
  Description of Artificial Sequence: Synthetic peptide
QSGNLAR

SEQ ID NO: 7115 - protein, 7 aa, Artificial Sequence
  Description of Artificial Sequence: Synthetic peptide
HQCCLTS

SEQ ID NO: 7116 - protein, 7 aa, Artificial Sequence
  Description of Artificial Sequence: Synthetic peptide
RSANLTR

SEQ ID NO: 7117 - protein, 7 aa, Artificial Sequence
  Description of Artificial Sequence: Synthetic peptide
RSANLAR

SEQ ID NO: 7118 - protein, 7 aa, Artificial Sequence
  Description of Artificial Sequence: Synthetic peptide
TNQNRIT

SEQ ID NO: 7119 - protein, 7 aa, Artificial Sequence
  Description of Artificial Sequence: Synthetic peptide
ATKDLAA

SEQ ID NO: 7120 - protein, 7 aa, Artificial Sequence
  Description of Artificial Sequence: Synthetic peptide
TSGHLSR

SEQ ID NO: 7121 - protein, 7 aa, Artificial Sequence
  Description of Artificial Sequence: Synthetic peptide
RSDNLSE

SEQ ID NO: 7122 - protein, 7 aa, Artificial Sequence
  Description of Artificial Sequence: Synthetic peptide
TSSNRKT

SEQ ID NO: 7123 - protein, 7 aa, Artificial Sequence
  Description of Artificial Sequence: Synthetic peptide
DRSALAR

SEQ ID NO: 7124 - protein, 7 aa, Artificial Sequence
  Description of Artificial Sequence: Synthetic peptide
RSDYLAK

SEQ ID NO: 7125 - protein, 7 aa, Artificial Sequence
  Description of Artificial Sequence: Synthetic peptide
RSDNLAR

SEQ ID NO: 7126 - protein, 7 aa, Artificial Sequence
  Description of Artificial Sequence: Synthetic peptide
QSNALNR

SEQ ID NO: 7127 - protein, 7 aa, Artificial Sequence
  Description of Artificial Sequence: Synthetic peptide
QKGTLGE

SEQ ID NO: 7128 - protein, 7 aa, Artificial Sequence
  Description of Artificial Sequence: Synthetic peptide
QSGSLTR

SEQ ID NO: 7129 - protein, 7 aa, Artificial Sequence
  Description of Artificial Sequence: Synthetic peptide
RSDSLLR

SEQ ID NO: 7130 - protein, 7 aa, Artificial Sequence
  Description of Artificial Sequence: Synthetic peptide
WSCCLRD

SEQ ID NO: 7131 - protein, 7 aa, Artificial Sequence
  Description of Artificial Sequence: Synthetic peptide
QSGSLTR

SEQ ID NO: 7132 - protein, 7 aa, Artificial Sequence
  Description of Artificial Sequence: Synthetic peptide
DRSYRNT

SEQ ID NO: 7133 - protein, 7 aa, Artificial Sequence
  Description of Artificial Sequence: Synthetic peptide
DQSNLRA

SEQ ID NO: 7134 - protein, 7 aa, Artificial Sequence
  Description of Artificial Sequence: Synthetic peptide
RHSHLTS

SEQ ID NO: 7135 - protein, 7 aa, Artificial Sequence
  Description of Artificial Sequence: Synthetic peptide
QSGNLAR

SEQ ID NO: 7136 - protein, 7 aa, Artificial Sequence
  Description of Artificial Sequence: Synthetic peptide
TSGNLTR

SEQ ID NO: 7137 - protein, 7 aa, Artificial Sequence
  Description of Artificial Sequence: Synthetic peptide
LSQDLNR

SEQ ID NO: 7138 - protein, 7 aa, Artificial Sequence
  Description of Artificial Sequence: Synthetic peptide
RSDSLSR

SEQ ID NO: 7139 - protein, 7 aa, Artificial Sequence
  Description of Artificial Sequence: Synthetic peptide
DSSARTK

SEQ ID NO: 7140 - protein, 7 aa, Artificial Sequence
  Description of Artificial Sequence: Synthetic peptide
RSDHLSA

SEQ ID NO: 7141 - protein, 7 aa, Artificial Sequence
  Description of Artificial Sequence: Synthetic peptide
CRRNLRN

SEQ ID NO: 7142 - protein, 7 aa, Artificial Sequence
  Description of Artificial Sequence: Synthetic peptide
SEADRSK

SEQ ID NO: 7143 - protein, 7 aa, Artificial Sequence
  Description of Artificial Sequence: Synthetic peptide
DRSNLTR

SEQ ID NO: 7144 - protein, 7 aa, Artificial Sequence
  Description of Artificial Sequence: Synthetic peptide
DRSALSR

SEQ ID NO: 7145 - protein, 7 aa, Artificial Sequence
  Description of Artificial Sequence: Synthetic peptide
TSSNRKT

SEQ ID NO: 7146 - protein, 7 aa, Artificial Sequence
  Description of Artificial Sequence: Synthetic peptide
ERGTLAR

SEQ ID NO: 7147 - protein, 7 aa, Artificial Sequence
  Description of Artificial Sequence: Synthetic peptide
DRSALAR

SEQ ID NO: 7148 - protein, 7 aa, Artificial Sequence
  Description of Artificial Sequence: Synthetic peptide
STDYRYP

SEQ ID NO: 7149 - protein, 7 aa, Artificial Sequence
  Description of Artificial Sequence: Synthetic peptide
QSGNLAR

SEQ ID NO: 7150 - protein, 7 aa, Artificial Sequence
  Description of Artificial Sequence: Synthetic peptide
RSDNLSV

SEQ ID NO: 7151 - protein, 7 aa, Artificial Sequence
  Description of Artificial Sequence: Synthetic peptide
TRWWLPE

SEQ ID NO: 7152 - protein, 7 aa, Artificial Sequence
  Description of Artificial Sequence: Synthetic peptide
RSDHLSQ

SEQ ID NO: 7153 - protein, 7 aa, Artificial Sequence
  Description of Artificial Sequence: Synthetic peptide
TRSPLTT

SEQ ID NO: 7154 - protein, 7 aa, Artificial Sequence
  Description of Artificial Sequence: Synthetic peptide
TNQSLHW

SEQ ID NO: 7155 - protein, 7 aa, Artificial Sequence
  Description of Artificial Sequence: Synthetic peptide
QSGNLAR

SEQ ID NO: 7156 - protein, 7 aa, Artificial Sequence
  Description of Artificial Sequence: Synthetic peptide
RPYTLRL

SEQ ID NO: 7157 - protein, 7 aa, Artificial Sequence
  Description of Artificial Sequence: Synthetic peptide
QSGSLTR

SEQ ID NO: 7158 - protein, 7 aa, Artificial Sequence
  Description of Artificial Sequence: Synthetic peptide
RSDVLSE

SEQ ID NO: 7159 - protein, 7 aa, Artificial Sequence
  Description of Artificial Sequence: Synthetic peptide
TSSNRKT

SEQ ID NO: 7160 - protein, 7 aa, Artificial Sequence
  Description of Artificial Sequence: Synthetic peptide
RSDVLST

SEQ ID NO: 7161 - protein, 7 aa, Artificial Sequence
  Description of Artificial Sequence: Synthetic peptide
RNSYLIS

SEQ ID NO: 7162 - protein, 7 aa, Artificial Sequence
  Description of Artificial Sequence: Synthetic peptide
RSANLAR

SEQ ID NO: 7163 - protein, 7 aa, Artificial Sequence
  Description of Artificial Sequence: Synthetic peptide
TNQNRIT

SEQ ID NO: 7164 - protein, 7 aa, Artificial Sequence
  Description of Artificial Sequence: Synthetic peptide
RSDNLSV

SEQ ID NO: 7165 - protein, 7 aa, Artificial Sequence
  Description of Artificial Sequence: Synthetic peptide
RSDHLSA

SEQ ID NO: 7166 - protein, 7 aa, Artificial Sequence
  Description of Artificial Sequence: Synthetic peptide
RSANLTR

SEQ ID NO: 7167 - protein, 7 aa, Artificial Sequence
  Description of Artificial Sequence: Synthetic peptide
LRHHLTR

SEQ ID NO: 7168 - protein, 7 aa, Artificial Sequence
  Description of Artificial Sequence: Synthetic peptide
DRSTLRQ

SEQ ID NO: 7169 - protein, 7 aa, Artificial Sequence
  Description of Artificial Sequence: Synthetic peptide
HNHDLRN

SEQ ID NO: 7170 - protein, 7 aa, Artificial Sequence
  Description of Artificial Sequence: Synthetic peptide
TSGNLTR

SEQ ID NO: 7171 - protein, 7 aa, Artificial Sequence
  Description of Artificial Sequence: Synthetic peptide
QSANRTT

SEQ ID NO: 7172 - protein, 7 aa, Artificial Sequence
  Description of Artificial Sequence: Synthetic peptide
QNAHRKT

SEQ ID NO: 7173 - protein, 7 aa, Artificial Sequence
  Description of Artificial Sequence: Synthetic peptide
QSGNLAR

SEQ ID NO: 7174 - protein, 7 aa, Artificial Sequence
  Description of Artificial Sequence: Synthetic peptide
QRNHRTT

SEQ ID NO: 7175 - protein, 7 aa, Artificial Sequence
  Description of Artificial Sequence: Synthetic peptide
QSANRTK

SEQ ID NO: 7176 - protein, 7 aa, Artificial Sequence
  Description of Artificial Sequence: Synthetic peptide
RSDHLSE

SEQ ID NO: 7177 - protein, 7 aa, Artificial Sequence
  Description of Artificial Sequence: Synthetic peptide
TSGSLTR

SEQ ID NO: 7178 - protein, 7 aa, Artificial Sequence
  Description of Artificial Sequence: Synthetic peptide
QSGALAR

SEQ ID NO: 7179 - protein, 7 aa, Artificial Sequence
  Description of Artificial Sequence: Synthetic peptide
QSGHLSR

SEQ ID NO: 7180 - protein, 7 aa, Artificial Sequence
  Description of Artificial Sequence: Synthetic peptide
YRWLRNS

SEQ ID NO: 7181 - protein, 7 aa, Artificial Sequence
  Description of Artificial Sequence: Synthetic peptide
TNSNRKR

SEQ ID NO: 7182 - protein, 7 aa, Artificial Sequence
  Description of Artificial Sequence: Synthetic peptide
QSANRTT

SEQ ID NO: 7183 - protein, 7 aa, Artificial Sequence
  Description of Artificial Sequence: Synthetic peptide
HRSSLRR

SEQ ID NO: 7184 - protein, 7 aa, Artificial Sequence
  Description of Artificial Sequence: Synthetic peptide
RSDVLSA

SEQ ID NO: 7185 - protein, 7 aa, Artificial Sequence
  Description of Artificial Sequence: Synthetic peptide
QNATRIN

SEQ ID NO: 7186 - protein, 7 aa, Artificial Sequence
  Description of Artificial Sequence: Synthetic peptide
RSDSLLR

SEQ ID NO: 7187 - protein, 7 aa, Artificial Sequence
  Description of Artificial Sequence: Synthetic peptide
QSCARNV

SEQ ID NO: 7188 - protein, 7 aa, Artificial Sequence
  Description of Artificial Sequence: Synthetic peptide
RPYTLRL

SEQ ID NO: 7189 - protein, 7 aa, Artificial Sequence
  Description of Artificial Sequence: Synthetic peptide
HRSSLRR

SEQ ID NO: 7190 - protein, 7 aa, Artificial Sequence
  Description of Artificial Sequence: Synthetic peptide
RSDSLLR

SEQ ID NO: 7191 - protein, 7 aa, Artificial Sequence
  Description of Artificial Sequence: Synthetic peptide
QSCARNV

SEQ ID NO: 7192 - protein, 7 aa, Artificial Sequence
  Description of Artificial Sequence: Synthetic peptide
QSSDLSR

SEQ ID NO: 7193 - protein, 7 aa, Artificial Sequence
  Description of Artificial Sequence: Synthetic peptide
YHWYLKK

SEQ ID NO: 7194 - protein, 7 aa, Artificial Sequence
  Description of Artificial Sequence: Synthetic peptide
QSANRTK

SEQ ID NO: 7195 - protein, 7 aa, Artificial Sequence
  Description of Artificial Sequence: Synthetic peptide
DNSNRIK

SEQ ID NO: 7196 - protein, 7 aa, Artificial Sequence
  Description of Artificial Sequence: Synthetic peptide
QSGNLAR

SEQ ID NO: 7197 - protein, 7 aa, Artificial Sequence
  Description of Artificial Sequence: Synthetic peptide
DRTNLNA

SEQ ID NO: 7198 - protein, 7 aa, Artificial Sequence
  Description of Artificial Sequence: Synthetic peptide
RSDNLSE

SEQ ID NO: 7199 - protein, 7 aa, Artificial Sequence
  Description of Artificial Sequence: Synthetic peptide
TSANLSR

SEQ ID NO: 7200 - protein, 7 aa, Artificial Sequence
  Description of Artificial Sequence: Synthetic peptide
QSANRTK

SEQ ID NO: 7201 - protein, 7 aa, Artificial Sequence
  Description of Artificial Sequence: Synthetic peptide
DNSYLPR

SEQ ID NO: 7202 - protein, 7 aa, Artificial Sequence
  Description of Artificial Sequence: Synthetic peptide
LKQNLDA

SEQ ID NO: 7203 - protein, 7 aa, Artificial Sequence
  Description of Artificial Sequence: Synthetic peptide
RSHHLKA

SEQ ID NO: 7204 - protein, 7 aa, Artificial Sequence
  Description of Artificial Sequence: Synthetic peptide
RSDHLSQ

SEQ ID NO: 7205 - protein, 7 aa, Artificial Sequence
  Description of Artificial Sequence: Synthetic peptide
TARLLKL

SEQ ID NO: 7206 - protein, 7 aa, Artificial Sequence
  Description of Artificial Sequence: Synthetic peptide
RSDNLTR

SEQ ID NO: 7207 - protein, 7 aa, Artificial Sequence
  Description of Artificial Sequence: Synthetic peptide
QSSDLSR

SEQ ID NO: 7208 - protein, 7 aa, Artificial Sequence
  Description of Artificial Sequence: Synthetic peptide
YHWYLKK

SEQ ID NO: 7209 - protein, 7 aa, Artificial Sequence
  Description of Artificial Sequence: Synthetic peptide
DRSNLSR

SEQ ID NO: 7210 - protein, 7 aa, Artificial Sequence
  Description of Artificial Sequence: Synthetic peptide
TSGNLTR

SEQ ID NO: 7211 - protein, 7 aa, Artificial Sequence
  Description of Artificial Sequence: Synthetic peptide
DRSNRTT

SEQ ID NO: 7212 - protein, 7 aa, Artificial Sequence
  Description of Artificial Sequence: Synthetic peptide
TNSNRKR

SEQ ID NO: 7213 - protein, 7 aa, Artificial Sequence
  Description of Artificial Sequence: Synthetic peptide
RSDSLSV

SEQ ID NO: 7214 - protein, 7 aa, Artificial Sequence
  Description of Artificial Sequence: Synthetic peptide
QNANRKT

SEQ ID NO: 7215 - protein, 7 aa, Artificial Sequence
  Description of Artificial Sequence: Synthetic peptide
TSGNLTR

SEQ ID NO: 7216 - protein, 7 aa, Artificial Sequence
  Description of Artificial Sequence: Synthetic peptide
QRSHLSD

SEQ ID NO: 7217 - protein, 7 aa, Artificial Sequence
  Description of Artificial Sequence: Synthetic peptide
RSDNLSE

SEQ ID NO: 7218 - protein, 7 aa, Artificial Sequence
  Description of Artificial Sequence: Synthetic peptide
VRRALSS

SEQ ID NO: 7219 - protein, 7 aa, Artificial Sequence
  Description of Artificial Sequence: Synthetic peptide
RSDNLSV

SEQ ID NO: 7220 - protein, 7 aa, Artificial Sequence
  Description of Artificial Sequence: Synthetic peptide
QSSNLAR

SEQ ID NO: 7221 - protein, 7 aa, Artificial Sequence
  Description of Artificial Sequence: Synthetic peptide
TSGSLTR

SEQ ID NO: 7222 - protein, 7 aa, Artificial Sequence
  Description of Artificial Sequence: Synthetic peptide
QSGNLAR

SEQ ID NO: 7223 - protein, 7 aa, Artificial Sequence
  Description of Artificial Sequence: Synthetic peptide
QKVNRAG

SEQ ID NO: 7224 - protein, 7 aa, Artificial Sequence
  Description of Artificial Sequence: Synthetic peptide
TSGSLSR

SEQ ID NO: 7225 - protein, 7 aa, Artificial Sequence
  Description of Artificial Sequence: Synthetic peptide
DSSALAK

SEQ ID NO: 7226 - protein, 7 aa, Artificial Sequence
  Description of Artificial Sequence: Synthetic peptide
QSGDLTR

SEQ ID NO: 7227 - protein, 7 aa, Artificial Sequence
  Description of Artificial Sequence: Synthetic peptide
RKDPLKE

SEQ ID NO: 7228 - protein, 7 aa, Artificial Sequence
  Description of Artificial Sequence: Synthetic peptide
QSGNLAR

SEQ ID NO: 7229 - protein, 7 aa, Artificial Sequence
  Description of Artificial Sequence: Synthetic peptide
ATCCLAH

SEQ ID NO: 7230 - protein, 7 aa, Artificial Sequence
  Description of Artificial Sequence: Synthetic peptide
QSSDLSR

SEQ ID NO: 7231 - protein, 7 aa, Artificial Sequence
  Description of Artificial Sequence: Synthetic peptide
RRDNLHS

SEQ ID NO: 7232 - protein, 7 aa, Artificial Sequence
  Description of Artificial Sequence: Synthetic peptide
QSGNLAR

SEQ ID NO: 7233 - protein, 7 aa, Artificial Sequence
  Description of Artificial Sequence: Synthetic peptide
HNSSLKD

SEQ ID NO: 7234 - protein, 7 aa, Artificial Sequence
  Description of Artificial Sequence: Synthetic peptide
QSGALAR

SEQ ID NO: 7235 - protein, 7 aa, Artificial Sequence
  Description of Artificial Sequence: Synthetic peptide
QSANRTK

SEQ ID NO: 7236 - protein, 7 aa, Artificial Sequence
  Description of Artificial Sequence: Synthetic peptide
RSDHLST

SEQ ID NO: 7237 - protein, 7 aa, Artificial Sequence
  Description of Artificial Sequence: Synthetic peptide
RSDHLSR

SEQ ID NO: 7238 - protein, 7 aa, Artificial Sequence
  Description of Artificial Sequence: Synthetic peptide
TSGNLTR

SEQ ID NO: 7239 - protein, 7 aa, Artificial Sequence
  Description of Artificial Sequence: Synthetic peptide
DSTNLRA

SEQ ID NO: 7240 - protein, 7 aa, Artificial Sequence
  Description of Artificial Sequence: Synthetic peptide
DRSHLAR

SEQ ID NO: 7241 - protein, 7 aa, Artificial Sequence
  Description of Artificial Sequence: Synthetic peptide
RSDDLTR

SEQ ID NO: 7242 - protein, 7 aa, Artificial Sequence
  Description of Artificial Sequence: Synthetic peptide
TSSNRKT

SEQ ID NO: 7243 - protein, 7 aa, Artificial Sequence
  Description of Artificial Sequence: Synthetic peptide
TSGNLTR

SEQ ID NO: 7244 - protein, 7 aa, Artificial Sequence
  Description of Artificial Sequence: Synthetic peptide
QSGALVI

SEQ ID NO: 7245 - protein, 7 aa, Artificial Sequence
  Description of Artificial Sequence: Synthetic peptide
QNAHRKT

SEQ ID NO: 7246 - protein, 7 aa, Artificial Sequence
  Description of Artificial Sequence: Synthetic peptide
LKHHLTD

SEQ ID NO: 7247 - protein, 7 aa, Artificial Sequence
  Description of Artificial Sequence: Synthetic peptide
RSDNLST

SEQ ID NO: 7248 - protein, 7 aa, Artificial Sequence
  Description of Artificial Sequence: Synthetic peptide
DRSNRKT

SEQ ID NO: 7249 - protein, 7 aa, Artificial Sequence
  Description of Artificial Sequence: Synthetic peptide
DRSALSR

SEQ ID NO: 7250 - protein, 7 aa, Artificial Sequence
  Description of Artificial Sequence: Synthetic peptide
RSDALTQ

SEQ ID NO: 7251 - protein, 7 aa, Artificial Sequence
  Description of Artificial Sequence: Synthetic peptide
DRSTRTK

SEQ ID NO: 7252 - protein, 7 aa, Artificial Sequence
  Description of Artificial Sequence: Synthetic peptide
QSGNLHV

SEQ ID NO: 7253 - protein, 7 aa, Artificial Sequence
  Description of Artificial Sequence: Synthetic peptide
RSDNLTR

SEQ ID NO: 7254 - protein, 7 aa, Artificial Sequence
  Description of Artificial Sequence: Synthetic peptide
DRSNLSR

SEQ ID NO: 7255 - protein, 7 aa, Artificial Sequence
  Description of Artificial Sequence: Synthetic peptide
QSGNLAR

SEQ ID NO: 7256 - protein, 7 aa, Artificial Sequence
  Description of Artificial Sequence: Synthetic peptide
RSDSLLR

SEQ ID NO: 7257 - protein, 7 aa, Artificial Sequence
  Description of Artificial Sequence: Synthetic peptide
WLSSLSA

SEQ ID NO: 7258 - protein, 7 aa, Artificial Sequence
  Description of Artificial Sequence: Synthetic peptide
RSDNLST

SEQ ID NO: 7259 - protein, 7 aa, Artificial Sequence
  Description of Artificial Sequence: Synthetic peptide
DSSSRIK

SEQ ID NO: 7260 - protein, 7 aa, Artificial Sequence
  Description of Artificial Sequence: Synthetic peptide
QSGALAR

SEQ ID NO: 7261 - protein, 7 aa, Artificial Sequence
  Description of Artificial Sequence: Synthetic peptide
QSGNLHV

SEQ ID NO: 7262 - protein, 7 aa, Artificial Sequence
  Description of Artificial Sequence: Synthetic peptide
RSDVLST

SEQ ID NO: 7263 - protein, 7 aa, Artificial Sequence
  Description of Artificial Sequence: Synthetic peptide
RYAYLTS

SEQ ID NO: 7264 - protein, 7 aa, Artificial Sequence
  Description of Artificial Sequence: Synthetic peptide
RSDNLSE

SEQ ID NO: 7265 - protein, 7 aa, Artificial Sequence
  Description of Artificial Sequence: Synthetic peptide
TRSPLRN

SEQ ID NO: 7266 - protein, 7 aa, Artificial Sequence
  Description of Artificial Sequence: Synthetic peptide
QNAHRKT

SEQ ID NO: 7267 - protein, 7 aa, Artificial Sequence
  Description of Artificial Sequence: Synthetic peptide
RSDHLSE

SEQ ID NO: 7268 - protein, 7 aa, Artificial Sequence
  Description of Artificial Sequence: Synthetic peptide
RNDNRKN

SEQ ID NO: 7269 - protein, 7 aa, Artificial Sequence
  Description of Artificial Sequence: Synthetic peptide
QRTNLVE

SEQ ID NO: 7270 - protein, 7 aa, Artificial Sequence
  Description of Artificial Sequence: Synthetic peptide
ASKTRTN

SEQ ID NO: 7271 - protein, 7 aa, Artificial Sequence
  Description of Artificial Sequence: Synthetic peptide
RSANLAR

SEQ ID NO: 7272 - protein, 7 aa, Artificial Sequence
  Description of Artificial Sequence: Synthetic peptide
RSDHLTQ

SEQ ID NO: 7273 - protein, 7 aa, Artificial Sequence
  Description of Artificial Sequence: Synthetic peptide
RSAHLSR

SEQ ID NO: 7274 - protein, 7 aa, Artificial Sequence
  Description of Artificial Sequence: Synthetic peptide
RSDNLSV

SEQ ID NO: 7275 - protein, 7 aa, Artificial Sequence
  Description of Artificial Sequence: Synthetic peptide
QNANRIT

SEQ ID NO: 7276 - protein, 7 aa, Artificial Sequence
  Description of Artificial Sequence: Synthetic peptide
DQSNLRA

SEQ ID NO: 7277 - protein, 7 aa, Artificial Sequence
  Description of Artificial Sequence: Synthetic peptide
QNAHRKT

SEQ ID NO: 7278 - protein, 7 aa, Artificial Sequence
  Description of Artificial Sequence: Synthetic peptide
RSAHLSR

SEQ ID NO: 7279 - protein, 7 aa, Artificial Sequence
  Description of Artificial Sequence: Synthetic peptide
DRSALAR

SEQ ID NO: 7280 - protein, 7 aa, Artificial Sequence
  Description of Artificial Sequence: Synthetic peptide
RSDYLAK

SEQ ID NO: 7281 - protein, 7 aa, Artificial Sequence
  Description of Artificial Sequence: Synthetic peptide
RSDDLSR

SEQ ID NO: 7282 - protein, 7 aa, Artificial Sequence
  Description of Artificial Sequence: Synthetic peptide
RNDNRTK

SEQ ID NO: 7283 - protein, 7 aa, Artificial Sequence
  Description of Artificial Sequence: Synthetic peptide
RSDHLST

SEQ ID NO: 7284 - protein, 7 aa, Artificial Sequence
  Description of Artificial Sequence: Synthetic peptide
HSNTRKN

SEQ ID NO: 7285 - protein, 7 aa, Artificial Sequence
  Description of Artificial Sequence: Synthetic peptide
RSDVLSE

SEQ ID NO: 7286 - protein, 7 aa, Artificial Sequence
  Description of Artificial Sequence: Synthetic peptide
QRSNLKV

SEQ ID NO: 7287 - protein, 7 aa, Artificial Sequence
  Description of Artificial Sequence: Synthetic peptide
QSSNLAR

SEQ ID NO: 7288 - protein, 7 aa, Artificial Sequence
  Description of Artificial Sequence: Synthetic peptide
QSGHLSR

SEQ ID NO: 7289 - protein, 7 aa, Artificial Sequence
  Description of Artificial Sequence: Synthetic peptide
DRSDLSR

SEQ ID NO: 7290 - protein, 7 aa, Artificial Sequence
  Description of Artificial Sequence: Synthetic peptide
LRFNLRN

SEQ ID NO: 7291 - protein, 7 aa, Artificial Sequence
  Description of Artificial Sequence: Synthetic peptide
RSDSLSV

SEQ ID NO: 7292 - protein, 7 aa, Artificial Sequence
  Description of Artificial Sequence: Synthetic peptide
QNANRKT

SEQ ID NO: 7293 - protein, 7 aa, Artificial Sequence
  Description of Artificial Sequence: Synthetic peptide
QSGDLTR

SEQ ID NO: 7294 - protein, 7 aa, Artificial Sequence
  Description of Artificial Sequence: Synthetic peptide
TSGSLTR

SEQ ID NO: 7295 - protein, 7 aa, Artificial Sequence
  Description of Artificial Sequence: Synthetic peptide
RSDDLTR

SEQ ID NO: 7296 - protein, 7 aa, Artificial Sequence
  Description of Artificial Sequence: Synthetic peptide
YRWLLRS

SEQ ID NO: 7297 - protein, 7 aa, Artificial Sequence
  Description of Artificial Sequence: Synthetic peptide
QSGDLTR

SEQ ID NO: 7298 - protein, 7 aa, Artificial Sequence
  Description of Artificial Sequence: Synthetic peptide
RSDNLST

SEQ ID NO: 7299 - protein, 7 aa, Artificial Sequence
  Description of Artificial Sequence: Synthetic peptide
AACNRNA

SEQ ID NO: 7300 - protein, 7 aa, Artificial Sequence
  Description of Artificial Sequence: Synthetic peptide
RPYTLRL

SEQ ID NO: 7301 - protein, 7 aa, Artificial Sequence
  Description of Artificial Sequence: Synthetic peptide
QSGSLTR

SEQ ID NO: 7302 - protein, 7 aa, Artificial Sequence
  Description of Artificial Sequence: Synthetic peptide
SQYTLRD

SEQ ID NO: 7303 - protein, 7 aa, Artificial Sequence
  Description of Artificial Sequence: Synthetic peptide
TSGHLSR

SEQ ID NO: 7304 - protein, 7 aa, Artificial Sequence
  Description of Artificial Sequence: Synthetic peptide
QSANRTK

SEQ ID NO: 7305 - protein, 7 aa, Artificial Sequence
  Description of Artificial Sequence: Synthetic peptide
DRSNRTT

SEQ ID NO: 7306 - protein, 7 aa, Artificial Sequence
  Description of Artificial Sequence: Synthetic peptide
RSDVLST

SEQ ID NO: 7307 - protein, 7 aa, Artificial Sequence
  Description of Artificial Sequence: Synthetic peptide
CRRNLRN

SEQ ID NO: 7308 - protein, 7 aa, Artificial Sequence
  Description of Artificial Sequence: Synthetic peptide
QSGDLTR

SEQ ID NO: 7309 - protein, 7 aa, Artificial Sequence
  Description of Artificial Sequence: Synthetic peptide
HRSSLLN

SEQ ID NO: 7310 - protein, 7 aa, Artificial Sequence
  Description of Artificial Sequence: Synthetic peptide
TNQSLHW

SEQ ID NO: 7311 - protein, 7 aa, Artificial Sequence
  Description of Artificial Sequence: Synthetic peptide
QSGNLAR

SEQ ID NO: 7312 - protein, 7 aa, Artificial Sequence
  Description of Artificial Sequence: Synthetic peptide
QSGNLAR

SEQ ID NO: 7313 - protein, 7 aa, Artificial Sequence
  Description of Artificial Sequence: Synthetic peptide
RSCCLHL

SEQ ID NO: 7314 - protein, 7 aa, Artificial Sequence
  Description of Artificial Sequence: Synthetic peptide
RNASRTR

SEQ ID NO: 7315 - protein, 7 aa, Artificial Sequence
  Description of Artificial Sequence: Synthetic peptide
QSGNLAR

SEQ ID NO: 7316 - protein, 7 aa, Artificial Sequence
  Description of Artificial Sequence: Synthetic peptide
RQEHRVA

SEQ ID NO: 7317 - protein, 7 aa, Artificial Sequence
  Description of Artificial Sequence: Synthetic peptide
RSDNLSE

SEQ ID NO: 7318 - protein, 7 aa, Artificial Sequence
  Description of Artificial Sequence: Synthetic peptide
TSSNRKT

SEQ ID NO: 7319 - protein, 7 aa, Artificial Sequence
  Description of Artificial Sequence: Synthetic peptide
RSDVLSE

SEQ ID NO: 7320 - protein, 7 aa, Artificial Sequence
  Description of Artificial Sequence: Synthetic peptide
QRSNLKV

SEQ ID NO: 7321 - protein, 7 aa, Artificial Sequence
  Description of Artificial Sequence: Synthetic peptide
QSGALAR

SEQ ID NO: 7322 - protein, 7 aa, Artificial Sequence
  Description of Artificial Sequence: Synthetic peptide
YRWLRNS

SEQ ID NO: 7323 - protein, 7 aa, Artificial Sequence
  Description of Artificial Sequence: Synthetic peptide
QSANRTT

SEQ ID NO: 7324 - protein, 7 aa, Artificial Sequence
  Description of Artificial Sequence: Synthetic peptide
DRSNRTT

SEQ ID NO: 7325 - protein, 7 aa, Artificial Sequence
  Description of Artificial Sequence: Synthetic peptide
QNAHRKT

SEQ ID NO: 7326 - protein, 7 aa, Artificial Sequence
  Description of Artificial Sequence: Synthetic peptide
LAHHLVQ

SEQ ID NO: 7327 - protein, 7 aa, Artificial Sequence
  Description of Artificial Sequence: Synthetic peptide
HAQGLRH

SEQ ID NO: 7328 - protein, 7 aa, Artificial Sequence
  Description of Artificial Sequence: Synthetic peptide
QSGHLSR

SEQ ID NO: 7329 - protein, 7 aa, Artificial Sequence
  Description of Artificial Sequence: Synthetic peptide
RSDDLTR

SEQ ID NO: 7330 - protein, 7 aa, Artificial Sequence
  Description of Artificial Sequence: Synthetic peptide
RRFTLSK

SEQ ID NO: 7331 - protein, 7 aa, Artificial Sequence
  Description of Artificial Sequence: Synthetic peptide
RSDNLSE

SEQ ID NO: 7332 - protein, 7 aa, Artificial Sequence
  Description of Artificial Sequence: Synthetic peptide
KSWSRYK

SEQ ID NO: 7333 - protein, 7 aa, Artificial Sequence
  Description of Artificial Sequence: Synthetic peptide
RSAHLSR

SEQ ID NO: 7334 - protein, 7 aa, Artificial Sequence
  Description of Artificial Sequence: Synthetic peptide
RSDDLTR

SEQ ID NO: 7335 - protein, 7 aa, Artificial Sequence
  Description of Artificial Sequence: Synthetic peptide
YSWTLRD

SEQ ID NO: 7336 - protein, 7 aa, Artificial Sequence
  Description of Artificial Sequence: Synthetic peptide
TSGNLTR

SEQ ID NO: 7337 - protein, 7 aa, Artificial Sequence
  Description of Artificial Sequence: Synthetic peptide
RSDVLST

SEQ ID NO: 7338 - protein, 7 aa, Artificial Sequence
  Description of Artificial Sequence: Synthetic peptide
DNSSRTR

SEQ ID NO: 7339 - protein, 7 aa, Artificial Sequence
  Description of Artificial Sequence: Synthetic peptide
RSDALAR

SEQ ID NO: 7340 - protein, 7 aa, Artificial Sequence
  Description of Artificial Sequence: Synthetic peptide
RSDSLSA

SEQ ID NO: 7341 - protein, 7 aa, Artificial Sequence
  Description of Artificial Sequence: Synthetic peptide
DRSDLSR

SEQ ID NO: 7342 - protein, 7 aa, Artificial Sequence
  Description of Artificial Sequence: Synthetic peptide
GTQGLGI

SEQ ID NO: 7343 - protein, 7 aa, Artificial Sequence
  Description of Artificial Sequence: Synthetic peptide
DRSNLTR

SEQ ID NO: 7344 - protein, 7 aa, Artificial Sequence
  Description of Artificial Sequence: Synthetic peptide
RNDDRKK

SEQ ID NO: 7345 - protein, 7 aa, Artificial Sequence
  Description of Artificial Sequence: Synthetic peptide
RSDVLSE

SEQ ID NO: 7346 - protein, 7 aa, Artificial Sequence
  Description of Artificial Sequence: Synthetic peptide
RSSDRTK

SEQ ID NO: 7347 - protein, 7 aa, Artificial Sequence
  Description of Artificial Sequence: Synthetic peptide
QSANRTK

SEQ ID NO: 7348 - protein, 7 aa, Artificial Sequence
  Description of Artificial Sequence: Synthetic peptide
DSSHRTR

SEQ ID NO: 7349 - protein, 7 aa, Artificial Sequence
  Description of Artificial Sequence: Synthetic peptide
QSANRTK

SEQ ID NO: 7350 - protein, 7 aa, Artificial Sequence
  Description of Artificial Sequence: Synthetic peptide
SVGNLNQ

SEQ ID NO: 7351 - protein, 7 aa, Artificial Sequence
  Description of Artificial Sequence: Synthetic peptide
TSGNLTR

SEQ ID NO: 7352 - protein, 7 aa, Artificial Sequence
  Description of Artificial Sequence: Synthetic peptide
TNQNRIT

SEQ ID NO: 7353 - protein, 7 aa, Artificial Sequence
  Description of Artificial Sequence: Synthetic peptide
HSNARKT

SEQ ID NO: 7354 - protein, 7 aa, Artificial Sequence
  Description of Artificial Sequence: Synthetic peptide
QSSHLTR

SEQ ID NO: 7355 - protein, 7 aa, Artificial Sequence
  Description of Artificial Sequence: Synthetic peptide
RLDNRTA

SEQ ID NO: 7356 - protein, 7 aa, Artificial Sequence
  Description of Artificial Sequence: Synthetic peptide
QSGNLAR

SEQ ID NO: 7357 - protein, 7 aa, Artificial Sequence
  Description of Artificial Sequence: Synthetic peptide
QGANLIK

SEQ ID NO: 7358 - protein, 7 aa, Artificial Sequence
  Description of Artificial Sequence: Synthetic peptide
RSDNLST

SEQ ID NO: 7359 - protein, 7 aa, Artificial Sequence
  Description of Artificial Sequence: Synthetic peptide
QKSPLNT

SEQ ID NO: 7360 - protein, 7 aa, Artificial Sequence
  Description of Artificial Sequence: Synthetic peptide
QSSDLSR

SEQ ID NO: 7361 - protein, 7 aa, Artificial Sequence
  Description of Artificial Sequence: Synthetic peptide
QSSDLSR

SEQ ID NO: 7362 - protein, 7 aa, Artificial Sequence
  Description of Artificial Sequence: Synthetic peptide
YHWYLKK

SEQ ID NO: 7363 - DNA, 18 bp, Artificial Sequence
  Description of Artificial Sequence: Synthetic oligonucleotide
tactattcctaagttaaa

SEQ ID NO: 7364 - DNA, 18 bp, Artificial Sequence
  Description of Artificial Sequence: Synthetic oligonucleotide
tggtactaggggataaag

SEQ ID NO: 7365 - DNA, 16 bp, Artificial Sequence
  Description of Artificial Sequence: Synthetic oligonucleotide
ggaggaatttagatac

SEQ ID NO: 7366 - DNA, 12 bp, Artificial Sequence
  Description of Artificial Sequence: Synthetic oligonucleotide
tacttgctggta

SEQ ID NO: 7367 - DNA, 12 bp, Artificial Sequence
  Description of Artificial Sequence: Synthetic oligonucleotide
atcatctgcaaa

SEQ ID NO: 7368 - DNA, 16 bp, Artificial Sequence
  Description of Artificial Sequence: Synthetic oligonucleotide
cttgaattcctatgga

SEQ ID NO: 7369 - DNA, 18 bp, Artificial Sequence
  Description of Artificial Sequence: Synthetic oligonucleotide
aacttgtgagtaaactgc

SEQ ID NO: 7370 - DNA, 12 bp, Artificial Sequence
  Description of Artificial Sequence: Synthetic oligonucleotide
attgcataataa

SEQ ID NO: 7371 - DNA, 16 bp, Artificial Sequence
  Description of Artificial Sequence: Synthetic oligonucleotide
gttgtcttgctgctat

SEQ ID NO: 7372 - DNA, 18 bp, Artificial Sequence
  Description of Artificial Sequence: Synthetic oligonucleotide
acacagggtatcttcgat

SEQ ID NO: 7373 - DNA, 16 bp, Artificial Sequence
  Description of Artificial Sequence: Synthetic oligonucleotide
atgtactcatattcat

SEQ ID NO: 7374 - DNA, 18 bp, Artificial Sequence
  Description of Artificial Sequence: Synthetic oligonucleotide
ggagtaagggaaaaagat

SEQ ID NO: 7375 - DNA, 20 bp, Artificial Sequence
  Description of Artificial Sequence: Synthetic oligonucleotide
gctcgtcattgaattgtgta

SEQ ID NO: 7376 - DNA, 16 bp, Artificial Sequence
  Description of Artificial Sequence: Synthetic oligonucleotide
gaaaaataattaatac

SEQ ID NO: 7377 - DNA, 18 bp, Artificial Sequence
  Description of Artificial Sequence: Synthetic oligonucleotide
ggatatataaacgatgaa

SEQ ID NO: 7378 - DNA, 12 bp, Artificial Sequence
  Description of Artificial Sequence: Synthetic oligonucleotide
ataatggaaccc

SEQ ID NO: 7379 - DNA, 15 bp, Artificial Sequence
  Description of Artificial Sequence: Synthetic oligonucleotide
gacgatcacctcgaa

SEQ ID NO: 7380 - DNA, 18 bp, Artificial Sequence
  Description of Artificial Sequence: Synthetic oligonucleotide
ccggtgtcagagagggcc

SEQ ID NO: 7381 - DNA, 19 bp, Artificial Sequence
  Description of Artificial Sequence: Synthetic oligonucleotide
aatgagagagagagaagca

SEQ ID NO: 7382 - DNA, 18 bp, Artificial Sequence
  Description of Artificial Sequence: Synthetic oligonucleotide
cagatcaatcagggtccc

SEQ ID NO: 7383 - DNA, 19 bp, Artificial Sequence
  Description of Artificial Sequence: Synthetic oligonucleotide
ctctacatggtaccactcg

SEQ ID NO: 7384 - DNA, 15 bp, Artificial Sequence
  Description of Artificial Sequence: Synthetic oligonucleotide
gaaaggcacctcgta

SEQ ID NO: 7385 - DNA, 18 bp, Artificial Sequence
  Description of Artificial Sequence: Synthetic oligonucleotide
atcagccacgatcctgca

SEQ ID NO: 7386 - DNA, 19 bp, Artificial Sequence
  Description of Artificial Sequence: Synthetic oligonucleotide
gtcgcccatgtctgactca

SEQ ID NO: 7387 - DNA, 20 bp, Artificial Sequence
  Description of Artificial Sequence: Synthetic oligonucleotide
ctatagttttaagtgaatta

SEQ ID NO: 7388 - DNA, 18 bp, Artificial Sequence
  Description of Artificial Sequence: Synthetic oligonucleotide
tatatggtattggaaatt

SEQ ID NO: 7389 - DNA, 15 bp, Artificial Sequence
  Description of Artificial Sequence: Synthetic oligonucleotide
catcgtctcatgctt

SEQ ID NO: 7390 - DNA, 18 bp, Artificial Sequence
  Description of Artificial Sequence: Synthetic oligonucleotide
gatcctacaagtgagagg

SEQ ID NO: 7391 - DNA, 15 bp, Artificial Sequence
  Description of Artificial Sequence: Synthetic oligonucleotide
ttttctttctcttta

SEQ ID NO: 7392 - DNA, 12 bp, Artificial Sequence
  Description of Artificial Sequence: Synthetic oligonucleotide
ggagtagttagg

SEQ ID NO: 7393 - DNA, 19 bp, Artificial Sequence
  Description of Artificial Sequence: Synthetic oligonucleotide
aacatctttaactcattgt

SEQ ID NO: 7394 - DNA, 19 bp, Artificial Sequence
  Description of Artificial Sequence: Synthetic oligonucleotide
atagtggttttgcatagtg

SEQ ID NO: 7395 - DNA, 20 bp, Artificial Sequence
  Description of Artificial Sequence: Synthetic oligonucleotide
cacgaaaaactaaatttgct

SEQ ID NO: 7396 - DNA, 18 bp, Artificial Sequence
  Description of Artificial Sequence: Synthetic oligonucleotide
aggtatttctaagatagg

SEQ ID NO: 7397 - DNA, 15 bp, Artificial Sequence
  Description of Artificial Sequence: Synthetic oligonucleotide
tttgctgagtgaagg

SEQ ID NO: 7398 - DNA, 20 bp, Artificial Sequence
  Description of Artificial Sequence: Synthetic oligonucleotide
caaatgtgataactgatgac

SEQ ID NO: 7399 - DNA, 15 bp, Artificial Sequence
  Description of Artificial Sequence: Synthetic oligonucleotide
aagatgaagcgagat

SEQ ID NO: 7400 - DNA, 18 bp, Artificial Sequence
  Description of Artificial Sequence: Synthetic oligonucleotide
atcgttcaagaagttgaa

SEQ ID NO: 7401 - DNA, 18 bp, Artificial Sequence
  Description of Artificial Sequence: Synthetic oligonucleotide
caggctggcaaaatggaa

SEQ ID NO: 7402 - DNA, 18 bp, Artificial Sequence
  Description of Artificial Sequence: Synthetic oligonucleotide
gggtggtaagtacttgaa

SEQ ID NO: 7403 - DNA, 16 bp, Artificial Sequence
  Description of Artificial Sequence: Synthetic oligonucleotide
aatgcgtggccacgat

SEQ ID NO: 7404 - DNA, 18 bp, Artificial Sequence
  Description of Artificial Sequence: Synthetic oligonucleotide
aactagcgtagagtagat

SEQ ID NO: 7405 - DNA, 15 bp, Artificial Sequence
  Description of Artificial Sequence: Synthetic oligonucleotide
gagaaagccatggtc

SEQ ID NO: 7406 - DNA, 12 bp, Artificial Sequence
  Description of Artificial Sequence: Synthetic oligonucleotide
tgtgtggaagac

SEQ ID NO: 7407 - DNA, 19 bp, Artificial Sequence
  Description of Artificial Sequence: Synthetic oligonucleotide
tggatgtcaagtattcaag

SEQ ID NO: 7408 - DNA, 15 bp, Artificial Sequence
  Description of Artificial Sequence: Synthetic oligonucleotide
taggggagaatacag

SEQ ID NO: 7409 - DNA, 15 bp, Artificial Sequence
  Description of Artificial Sequence: Synthetic oligonucleotide
gggagggagacccaa

SEQ ID NO: 7410 - DNA, 15 bp, Artificial Sequence
  Description of Artificial Sequence: Synthetic oligonucleotide
gggagaaacaaaaag

SEQ ID NO: 7411 - DNA, 19 bp, Artificial Sequence
  Description of Artificial Sequence: Synthetic oligonucleotide
gtttggttaggcgcagatc

SEQ ID NO: 7412 - DNA, 13 bp, Artificial Sequence
  Description of Artificial Sequence: Synthetic oligonucleotide
ggagaaacaactg

SEQ ID NO: 7413 - DNA, 13 bp, Artificial Sequence
  Description of Artificial Sequence: Synthetic oligonucleotide
aaagtgtcatgcc

SEQ ID NO: 7414 - DNA, 15 bp, Artificial Sequence
  Description of Artificial Sequence: Synthetic oligonucleotide
gcaattgcggttgca

SEQ ID NO: 7415 - DNA, 18 bp, Artificial Sequence
  Description of Artificial Sequence: Synthetic oligonucleotide
ggtatcgtattgcattag

SEQ ID NO: 7416 - DNA, 12 bp, Artificial Sequence
  Description of Artificial Sequence: Synthetic oligonucleotide
cgcacgtaataa

SEQ ID NO: 7417 - DNA, 15 bp, Artificial Sequence
  Description of Artificial Sequence: Synthetic oligonucleotide
gaagaaattattgca

SEQ ID NO: 7418 - DNA, 18 bp, Artificial Sequence
  Description of Artificial Sequence: Synthetic oligonucleotide
aatcagagggaagtgaga

SEQ ID NO: 7419 - DNA, 19 bp, Artificial Sequence
  Description of Artificial Sequence: Synthetic oligonucleotide
aactaacttgtaacaactg

SEQ ID NO: 7420 - DNA, 18 bp, Artificial Sequence
  Description of Artificial Sequence: Synthetic oligonucleotide
ttggcgggaattagtaga

SEQ ID NO: 7421 - DNA, 18 bp, Artificial Sequence
  Description of Artificial Sequence: Synthetic oligonucleotide
gatcttgcggggtagcag

SEQ ID NO: 7422 - DNA, 15 bp, Artificial Sequence
  Description of Artificial Sequence: Synthetic oligonucleotide
gacctggtggtcatg

SEQ ID NO: 7423 - DNA, 15 bp, Artificial Sequence
  Description of Artificial Sequence: Synthetic oligonucleotide
tctatgtcggacttt

SEQ ID NO: 7424 - DNA, 16 bp, Artificial Sequence
  Description of Artificial Sequence: Synthetic oligonucleotide
gatcatttaaggataa

SEQ ID NO: 7425 - DNA, 18 bp, Artificial Sequence
  Description of Artificial Sequence: Synthetic oligonucleotide
atgaattcccttttctta

SEQ ID NO: 7426 - DNA, 15 bp, Artificial Sequence
  Description of Artificial Sequence: Synthetic oligonucleotide
tttgctgctttatag

SEQ ID NO: 7427 - DNA, 19 bp, Artificial Sequence
  Description of Artificial Sequence: Synthetic primer
caaacaaggagagagcgag

SEQ ID NO: 7428 - DNA, 20 bp, Artificial Sequence
  Description of Artificial Sequence: Synthetic primer
gatcgacattgatctggcta

SEQ ID NO: 7429 - DNA, 17 bp, Artificial Sequence
  Description of Artificial Sequence: Synthetic primer
ggcaaggacacaaacgg

SEQ ID NO: 7430 - DNA, 22 bp, Artificial Sequence
  Description of Artificial Sequence: Synthetic primer
atatgtgtcctaccgtatcagg

SEQ ID NO: 7431 - DNA, 23 bp, Artificial Sequence
  Description of Artificial Sequence: Synthetic primer
tacccaagaagaaacattagacc

SEQ ID NO: 7432 - DNA, 17 bp, Artificial Sequence
  Description of Artificial Sequence: Synthetic primer
gttgccttggtaggtcc

SEQ ID NO: 7433 - DNA, 22 bp, Artificial Sequence
  Description of Artificial Sequence: Synthetic primer
atgtagttgtttctctgctgtg

SEQ ID NO: 7434 - DNA, 18 bp, Artificial Sequence
  Description of Artificial Sequence: Synthetic primer
gagccatcagtccaacac

SEQ ID NO: 7435 - DNA, 17 bp, Artificial Sequence
  Description of Artificial Sequence: Synthetic primer
cacgaggtttacgccat

SEQ ID NO: 7436 - DNA, 22 bp, Artificial Sequence
  Description of Artificial Sequence: Synthetic primer
tctgataacttgctagtgtgtg

SEQ ID NO: 7437 - DNA, 17 bp, Artificial Sequence
  Description of Artificial Sequence: Synthetic primer
gctgctcagtggatgtc

SEQ ID NO: 7438 - DNA, 20 bp, Artificial Sequence
  Description of Artificial Sequence: Synthetic primer
tcgtttatcgggattgtctc

SEQ ID NO: 7439 - DNA, 20 bp, Artificial Sequence
  Description of Artificial Sequence: Synthetic primer
ttgttgcttctatgctcctc

SEQ ID NO: 7440 - DNA, 17 bp, Artificial Sequence
  Description of Artificial Sequence: Synthetic primer
cgtcgttgtggatgagg

SEQ ID NO: 7441 - DNA, 18 bp, Artificial Sequence
  Description of Artificial Sequence: Synthetic primer
ccattgctgttctgcttg

SEQ ID NO: 7442 - DNA, 17 bp, Artificial Sequence
  Description of Artificial Sequence: Synthetic primer
tgtaggtgacgggtgtg

SEQ ID NO: 7443 - DNA, 22 bp, Artificial Sequence
  Description of Artificial Sequence: Synthetic primer
gtgtgttattgtctgtgttctc

SEQ ID NO: 7444 - DNA, 20 bp, Artificial Sequence
  Description of Artificial Sequence: Synthetic primer
gactcctatgtgcctgattc

SEQ ID NO: 7445 - DNA, 22 bp, Artificial Sequence
  Description of Artificial Sequence: Synthetic primer
gagaacgatggatagaaaagca

SEQ ID NO: 7446 - DNA, 20 bp, Artificial Sequence
  Description of Artificial Sequence: Synthetic primer
tttgtttcagtcttgctcct

SEQ ID NO: 7447 - DNA, 21 bp, Artificial Sequence
  Description of Artificial Sequence: Synthetic primer
ctacctataaactggacggac

SEQ ID NO: 7448 - DNA, 21 bp, Artificial Sequence
  Description of Artificial Sequence: Synthetic primer
cgtcaaatgcccattattcat

SEQ ID NO: 7449 - DNA, 18 bp, Artificial Sequence
  Description of Artificial Sequence: Synthetic primer
gatttgggcttgggcata

SEQ ID NO: 7450 - DNA, 19 bp, Artificial Sequence
  Description of Artificial Sequence: Synthetic primer
tgaatcccactagcaccat

SEQ ID NO: 7451 - DNA, 24 bp, Artificial Sequence
  Description of Artificial Sequence: Synthetic primer
ggagatagagttagaaggttttga

SEQ ID NO: 7452 - DNA, 18 bp, Artificial Sequence
  Description of Artificial Sequence: Synthetic primer
gaggttgttttgacgcca

SEQ ID NO: 7453 - DNA, 25 bp, Artificial Sequence
  Description of Artificial Sequence: Synthetic primer
aaggaagaaatgtgaaaaagaagac

SEQ ID NO: 7454 - DNA, 19 bp, Artificial Sequence
  Description of Artificial Sequence: Synthetic primer
agagaagcgaaacccaaag

SEQ ID NO: 7455 - DNA, 22 bp, Artificial Sequence
  Description of Artificial Sequence: Synthetic primer
gacccatttatctatcccgtat

SEQ ID NO: 7456 - DNA, 22 bp, Artificial Sequence
  Description of Artificial Sequence: Synthetic primer
ggctcgtatcagttccatttag

SEQ ID NO: 7457 - DNA, 22 bp, Artificial Sequence
  Description of Artificial Sequence: Synthetic primer
aagtacgaacaagattggtgag

SEQ ID NO: 7458 - DNA, 23 bp, Artificial Sequence
  Description of Artificial Sequence: Synthetic primer
tctattacattccatccaaaggc

SEQ ID NO: 7459 - DNA, 22 bp, Artificial Sequence
  Description of Artificial Sequence: Synthetic primer
gaaacgagagagatgaccaata

SEQ ID NO: 7460 - DNA, 16 bp, Artificial Sequence
  Description of Artificial Sequence: Synthetic primer
ggttcacgggttcagc

SEQ ID NO: 7461 - DNA, 21 bp, Artificial Sequence
  Description of Artificial Sequence: Synthetic primer
cctgacgcaaaagaagaaatg

SEQ ID NO: 7462 - DNA, 23 bp, Artificial Sequence
  Description of Artificial Sequence: Synthetic primer
gttatacttactgtcaccacgag

SEQ ID NO: 7463 - DNA, 19 bp, Artificial Sequence
  Description of Artificial Sequence: Synthetic primer
ttattcctgcgtctctcac

SEQ ID NO: 7464 - DNA, 20 bp, Artificial Sequence
  Description of Artificial Sequence: Synthetic primer
ttgtgcgtgataaatagggc

SEQ ID NO: 7465 - DNA, 25 bp, Artificial Sequence
  Description of Artificial Sequence: Synthetic primer
gatagttgattgtgttgttagcata

SEQ ID NO: 7466 - DNA, 17 bp, Artificial Sequence
  Description of Artificial Sequence: Synthetic primer
ctcacctgttgcccgta

SEQ ID NO: 7467 - DNA, 18 bp, Artificial Sequence
  Description of Artificial Sequence: Synthetic primer
gtttgagttggcaggtgt

SEQ ID NO: 7468 - DNA, 18 bp, Artificial Sequence
  Description of Artificial Sequence: Synthetic primer
ccgtgacttgtgctagag

SEQ ID NO: 7469 - DNA, 16 bp, Artificial Sequence
  Description of Artificial Sequence: Synthetic primer
ctgaagttgacgccgc

SEQ ID NO: 7470 - DNA, 18 bp, Artificial Sequence
  Description of Artificial Sequence: Synthetic primer
aagcacaggacggttaga

SEQ ID NO: 7471 - DNA, 20 bp, Artificial Sequence
  Description of Artificial Sequence: Synthetic primer
cacgggtcacaaatctagtt

SEQ ID NO: 7472 - DNA, 23 bp, Artificial Sequence
  Description of Artificial Sequence: Synthetic primer
ccattaagtctgtctcaactttc

SEQ ID NO: 7473 - DNA, 21 bp, Artificial Sequence
  Description of Artificial Sequence: Synthetic primer
ctgcttgagtaggaagaagtg

SEQ ID NO: 7474 - DNA, 18 bp, Artificial Sequence
  Description of Artificial Sequence: Synthetic primer
atcaccaaagccgagaac

SEQ ID NO: 7475 - DNA, 16 bp, Artificial Sequence
  Description of Artificial Sequence: Synthetic primer
gtaggcgtgaaggctg

SEQ ID NO: 7476 - DNA, 18 bp, Artificial Sequence
  Description of Artificial Sequence: Synthetic primer
tgaaaccgcacaatctcg

SEQ ID NO: 7477 - DNA, 17 bp, Artificial Sequence
  Description of Artificial Sequence: Synthetic primer
ccctccgaaacaatccg

SEQ ID NO: 7478 - DNA, 16 bp, Artificial Sequence
  Description of Artificial Sequence: Synthetic primer
acccgttgaatgcgag

SEQ ID NO: 7479 - DNA, 17 bp, Artificial Sequence
  Description of Artificial Sequence: Synthetic primer
aaggtggatgggaggaa

SEQ ID NO: 7480 - DNA, 25 bp, Artificial Sequence
  Description of Artificial Sequence: Synthetic primer
tggcactaatacattacataagact

SEQ ID NO: 7481 - DNA, 21 bp, Artificial Sequence
  Description of Artificial Sequence: Synthetic primer
atgttacttcaatccctcgtc

SEQ ID NO: 7482 - DNA, 20 bp, Artificial Sequence
  Description of Artificial Sequence: Synthetic primer
tgaatagggcaaaaacacac

SEQ ID NO: 7483 - DNA, 15 bp, Artificial Sequence
  Description of Artificial Sequence: Synthetic primer
caagtgagcagggcg

SEQ ID NO: 7484 - DNA, 24 bp, Artificial Sequence
  Description of Artificial Sequence: Synthetic primer
ctatcattcgtaaagtttgaggac

SEQ ID NO: 7485 - DNA, 19 bp, Artificial Sequence
  Description of Artificial Sequence: Synthetic primer
agcctcactcacaacaaag

SEQ ID NO: 7486 - DNA, 22 bp, Artificial Sequence
  Description of Artificial Sequence: Synthetic primer
tgaaactgtcttgtgacttacc

SEQ ID NO: 7487 - DNA, 20 bp, Artificial Sequence
  Description of Artificial Sequence: Synthetic primer
gcactgacataccaacaatc

SEQ ID NO: 7488 - DNA, 21 bp, Artificial Sequence
  Description of Artificial Sequence: Synthetic primer
gttgtcgggatttcacttcat

SEQ ID NO: 7489 - DNA, 21 bp, Artificial Sequence
  Description of Artificial Sequence: Synthetic primer
gataggagaaagagcaaggac

SEQ ID NO: 7490 - DNA, 24 bp, Artificial Sequence
  Description of Artificial Sequence: Synthetic primer
ttctcaacatcaactcatacactc

SEQ ID NO: 7491 - DNA, 20 bp, Artificial Sequence
  Description of Artificial Sequence: Synthetic primer
ctcaaagcaacatcaaccat

SEQ ID NO: 7492 - DNA, 18 bp, Artificial Sequence
  Description of Artificial Sequence: Synthetic primer
aatcccaaagcagccaac

SEQ ID NO: 7493 - DNA, 25 bp, Artificial Sequence
  Description of Artificial Sequence: Synthetic primer
aaacacaaatcacatcatagtaaac

SEQ ID NO: 7494 - DNA, 23 bp, Artificial Sequence
  Description of Artificial Sequence: Synthetic primer
gctagtatgcttctgtcagttta

SEQ ID NO: 7495 - DNA, 21 bp, Artificial Sequence
  Description of Artificial Sequence: Synthetic primer
actagttctttcccgaacatt

SEQ ID NO: 7496 - DNA, 24 bp, Artificial Sequence
  Description of Artificial Sequence: Synthetic primer
catttggtgatttaactcatcagc

SEQ ID NO: 7497 - DNA, 20 bp, Artificial Sequence
  Description of Artificial Sequence: Synthetic primer
aaatttaccacggttggtcc

SEQ ID NO: 7498 - DNA, 23 bp, Artificial Sequence
  Description of Artificial Sequence: Synthetic primer
tctgcattaactatatcaggagg

SEQ ID NO: 7499 - DNA, 22 bp, Artificial Sequence
  Description of Artificial Sequence: Synthetic primer
attcaacatttacccttcacaa

SEQ ID NO: 7500 - DNA, 23 bp, Artificial Sequence
  Description of Artificial Sequence: Synthetic primer
aattctttctcatacttggttgt

SEQ ID NO: 7501 - DNA, 23 bp, Artificial Sequence
  Description of Artificial Sequence: Synthetic primer
ccttgttttccgtactatcaatt

SEQ ID NO: 7502 - DNA, 22 bp, Artificial Sequence
  Description of Artificial Sequence: Synthetic primer
tattggagtaatgtggacaagc

SEQ ID NO: 7503 - DNA, 20 bp, Artificial Sequence
  Description of Artificial Sequence: Synthetic primer
aacaactttccaacccacaa

SEQ ID NO: 7504 - DNA, 21 bp, Artificial Sequence
  Description of Artificial Sequence: Synthetic primer
cgttttaccttgacttgacct

SEQ ID NO: 7505 - DNA, 19 bp, Artificial Sequence
  Description of Artificial Sequence: Synthetic primer
ccagagaggaaccagaagt

SEQ ID NO: 7506 - DNA, 21 bp, Artificial Sequence
  Description of Artificial Sequence: Synthetic primer
ccttagacaaaactcgcactt

SEQ ID NO: 7507 - DNA, 18 bp, Artificial Sequence
  Description of Artificial Sequence: Synthetic primer
gaaagagaagacgccacc

SEQ ID NO: 7508 - DNA, 21 bp, Artificial Sequence
  Description of Artificial Sequence: Synthetic primer
tcattagagggtcaaaagtgc

SEQ ID NO: 7509 - DNA, 20 bp, Artificial Sequence
  Description of Artificial Sequence: Synthetic primer
cctgaagaaaagtgggagaa

SEQ ID NO: 7510 - DNA, 29 bp, Artificial Sequence
  Description of Artificial Sequence: Synthetic primer
ttcaatcataattaaactaataagactgt

SEQ ID NO: 7511 - DNA, 20 bp, Artificial Sequence
  Description of Artificial Sequence: Synthetic primer
actgaatgtattgtccgacg

SEQ ID NO: 7512 - DNA, 23 bp, Artificial Sequence
  Description of Artificial Sequence: Synthetic primer
gccctacattttcatttcattgg

SEQ ID NO: 7513 - DNA, 15 bp, Artificial Sequence
  Description of Artificial Sequence: Synthetic primer
gtgagaccgcccctt

SEQ ID NO: 7514 - DNA, 24 bp, Artificial Sequence
  Description of Artificial Sequence: Synthetic primer
ccactactttttactcacagaaga

SEQ ID NO: 7515 - DNA, 23 bp, Artificial Sequence
  Description of Artificial Sequence: Synthetic primer
gtcaattctcatcagttccatct

SEQ ID NO: 7516 - DNA, 23 bp, Artificial Sequence
  Description of Artificial Sequence: Synthetic primer
cgatgaatagtatgagtgcgtag

SEQ ID NO: 7517 - DNA, 18 bp, Artificial Sequence
  Description of Artificial Sequence: Synthetic primer
tgcgtctcttgcttccta

SEQ ID NO: 7518 - DNA, 21 bp, Artificial Sequence
  Description of Artificial Sequence: Synthetic primer
gccacgagaggatagaataat

SEQ ID NO: 7519 - DNA, 21 bp, Artificial Sequence
  Description of Artificial Sequence: Synthetic primer
tagtgtaccctcctcatcata

SEQ ID NO: 7520 - DNA, 24 bp, Artificial Sequence
  Description of Artificial Sequence: Synthetic primer
gataatcaaatgagtggacgaata

SEQ ID NO: 7521 - DNA, 22 bp, Artificial Sequence
  Description of Artificial Sequence: Synthetic primer
tgtatttggataagtgtgggac

SEQ ID NO: 7522 - DNA, 23 bp, Artificial Sequence
  Description of Artificial Sequence: Synthetic primer
gattttagcgtgattgatggaag

SEQ ID NO: 7523 - DNA, 20 bp, Artificial Sequence
  Description of Artificial Sequence: Synthetic primer
ctgaagcaagtggtgatgtt

SEQ ID NO: 7524 - DNA, 16 bp, Artificial Sequence
  Description of Artificial Sequence: Synthetic primer
cttaccaccacctgcg

SEQ ID NO: 7525 - DNA, 19 bp, Artificial Sequence
  Description of Artificial Sequence: Synthetic primer
gcataaaggtcagcagagg

SEQ ID NO: 7526 - DNA, 21 bp, Artificial Sequence
  Description of Artificial Sequence: Synthetic primer
tactctttagccatagccaat

SEQ ID NO: 7527 - DNA, 19 bp, Artificial Sequence
  Description of Artificial Sequence: Synthetic primer
gtttattgccagagacggt

SEQ ID NO: 7528 - DNA, 17 bp, Artificial Sequence
  Description of Artificial Sequence: Synthetic primer
cgtcgttgcttgcttgt

SEQ ID NO: 7529 - DNA, 25 bp, Artificial Sequence
  Description of Artificial Sequence: Synthetic primer
ggaaagacataaaagtaaatggaag

SEQ ID NO: 7530 - DNA, 23 bp, Artificial Sequence
  Description of Artificial Sequence: Synthetic primer
taactacctgataacctcctttt

SEQ ID NO: 7531 - DNA, 24 bp, Artificial Sequence
  Description of Artificial Sequence: Synthetic primer
gcaaactttaagtaaactagaggc

SEQ ID NO: 7532 - DNA, 23 bp, Artificial Sequence
  Description of Artificial Sequence: Synthetic primer
agtgtactctagtcagattttgc

SEQ ID NO: 7533 - DNA, 19 bp, Artificial Sequence
  Description of Artificial Sequence: Synthetic primer
caacccaacaagcaaacac

SEQ ID NO: 7534 - DNA, 24 bp, Artificial Sequence
  Description of Artificial Sequence: Synthetic primer
ctcggttttgtagtcatctatgta

SEQ ID NO: 7535 - DNA, 20 bp, Artificial Sequence
  Description of Artificial Sequence: Synthetic primer
gatgaataacagtgcgagga

SEQ ID NO: 7536 - DNA, 21 bp, Artificial Sequence
  Description of Artificial Sequence: Synthetic primer
ctgtaatcctcattttgcacg

SEQ ID NO: 7537 - DNA, 19 bp, Artificial Sequence
  Description of Artificial Sequence: Synthetic primer
ggggtagttacacttctgc

SEQ ID NO: 7538 - DNA, 19 bp, Artificial Sequence
  Description of Artificial Sequence: Synthetic primer
ggtgtggtcggcatataga

SEQ ID NO: 7539 - DNA, 16 bp, Artificial Sequence
  Description of Artificial Sequence: Synthetic primer
ttcgcacaagccatcc

SEQ ID NO: 7540 - DNA, 22 bp, Artificial Sequence
  Description of Artificial Sequence: Synthetic primer
aacgactttttgaatagatgct

SEQ ID NO: 7541 - DNA, 19 bp, Artificial Sequence
  Description of Artificial Sequence: Synthetic primer
gcattccttcttgtctcgt

SEQ ID NO: 7542 - DNA, 25 bp, Artificial Sequence
  Description of Artificial Sequence: Synthetic primer
aacttagagaaactcataactcatc

SEQ ID NO: 7543 - DNA, 21 bp, Artificial Sequence
  Description of Artificial Sequence: Synthetic primer
tcatagcttcaagggattcac

SEQ ID NO: 7544 - DNA, 20 bp, Artificial Sequence
  Description of Artificial Sequence: Synthetic primer
gttcatcaaaacacgcaaga

SEQ ID NO: 7545 - DNA, 18 bp, Artificial Sequence
  Description of Artificial Sequence: Synthetic primer
ctcatgccaacaaaagcc

SEQ ID NO: 7546 - DNA, 25 bp, Artificial Sequence
  Description of Artificial Sequence: Synthetic primer
gtagtaacaaaaatggataacgcag

SEQ ID NO: 7547 - DNA, 20 bp, Artificial Sequence
  Description of Artificial Sequence: Synthetic primer
tatctggcttgaagctgaat

SEQ ID NO: 7548 - DNA, 20 bp, Artificial Sequence
  Description of Artificial Sequence: Synthetic primer
ttatttccttcgtggcttcg

SEQ ID NO: 7549 - DNA, 21 bp, Artificial Sequence
  Description of Artificial Sequence: Synthetic primer
ctccacaatttagcatccaag

SEQ ID NO: 7550 - DNA, 20 bp, Artificial Sequence
  Description of Artificial Sequence: Synthetic primer
cgtccatgtttacttggcta

SEQ ID NO: 7551 - DNA, 22 bp, Artificial Sequence
  Description of Artificial Sequence: Synthetic primer
tctgttgattcctaatcgtagc

SEQ ID NO: 7552 - DNA, 24 bp, Artificial Sequence
  Description of Artificial Sequence: Synthetic primer
gtgattgacatttgtctataagca

SEQ ID NO: 7553 - DNA, 20 bp, Artificial Sequence
  Description of Artificial Sequence: Synthetic primer
cctcttcactgtgactgaac

SEQ ID NO: 7554 - DNA, 21 bp, Artificial Sequence
  Description of Artificial Sequence: Synthetic primer
tttcggcttgacatttctttc

SEQ ID NO: 7555 - DNA, 17 bp, Artificial Sequence
  Description of Artificial Sequence: Synthetic primer
tggcaaatcacacggtc

SEQ ID NO: 7556 - DNA, 20 bp, Artificial Sequence
  Description of Artificial Sequence: Synthetic primer
actaccttgcccctaagatc

SEQ ID NO: 7557 - DNA, 20 bp, Artificial Sequence
  Description of Artificial Sequence: Synthetic primer
tgccacgacaagaatttcat

SEQ ID NO: 7558 - DNA, 17 bp, Artificial Sequence
  Description of Artificial Sequence: Synthetic primer
tggtgtgattccaacgc

SEQ ID NO: 7559 - DNA, 19 bp, Artificial Sequence
  Description of Artificial Sequence: Synthetic primer
caaattcccactaagcgct

SEQ ID NO: 7560 - DNA, 18 bp, Artificial Sequence
  Description of Artificial Sequence: Synthetic primer
taaaggtgagcagaggca

SEQ ID NO: 7561 - DNA, 2457 bp, artificial sequence
  pDAB124280 plasmid map
gcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcaggcagaagcagaactaaacctaaatgggtcaaattattgttagctagttttgtaaatttaaattgatgctccgaaaaatttactataggaccccattgtcacactattcaaaaagttactaatatcctcgtcttggagaaaaagatttaacagaaagtgaggaagatcacattttaacttaggaatagtagctattggtactaggggataaagtagtgaagaactttaaactgaaagatccaaaacaattttatagtacataaaattgaattttgggatgtgggacaagcacaaacatcacaccattgatgatctctaccaatcgtttcgaacatctcatcacaatgatggaccccaatgagccacaggttagtagagtggtaggagcagtgttggactgatggctcgcttacataagcagttctgtcccatggagccaatgtcctgatacggtaggacacatatcccttaatgaatcggccaacgcgcggggagaggcggttt

SEQ ID NO: 7562 - DNA, 2401 bp, artificial sequence
  pDAB124281
gcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcagacgtacaaagtgccaacatcagatctcttcaattttagatatgaagaaatatgaaaaggcttttttactttcttgatttttccttgtaataatacagatgatctactgattatatattgatcgtctccgttcccaggattaggagaagaaaatctcttgaaaatatgcattagaggaacatgcattaacctgaaagtgaaagaggagtgtatctaaattcctccagtcatacttgctggtatatatactttaatgttctcttccactttaccaaactctttaacaaaagctaaattcaagtggagccacaggttagtagagtggtaggagcagtgttggactgatggctcgcttacataagcagttctgtcccatggagccaatgtcctgatacggtaggacacatatcccttaatgaatcggccaacgcgcggggagaggcggttt

SEQ ID NO: 7563 - DNA, 2315 bp, artificial sequence
  plasmid map of pDAB121278
gtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcagttgtttgaggcgtgctttctgatactgcgtaaagcttgtgcatttcttcttccaaaaaagacccttcactcagcaaattgttacaaatgtgataactgatgacgaggtcaaactgtgtgccactaaattcatcccatatgaggggagaaaacaaggaattaagcaaaactgtgtgtcatggtttccaggtgtgagttgcttatggaaaaccatggtgagccacaggttagtagagtggtaggagcagtgttggactgatggctcgcttacataagcagttctgtcccatggagccaatgtcctgatacggtaggacacatatcccttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggct

SEQ ID NO: 7564 - DNA, 2322 bp, artificial sequence
  plasmid map of pDAB123812
gcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcagtttaatatctagcaaattcaaatttaaatcacgcgtttatcgagtctaccaaattattattgagtagtctaccaaaaaacaaatgttgttaacaaattaacttagaatgtatatgtgaagttgtgagtttggtaaacatccatatatccctggatgccaatactctctaatgcaatacgataccaaacacgcacgtaataacttaattctaaaatctaatttagagccacaggttagtagagtggtaggagcagtgttggactgatggctcgcttacataagcagttctgtcccatggagccaatgtcctgatacggtaggacacatatcccttaatgaatcggccaacgcgcggggagaggcggttt

SEQ ID NO: 7565 - DNA, 2322 bp, artificial sequence; identical to SEQ ID NO: 7564
  plasmid map of pDAB123812

SEQ ID NO: 7566 - DNA, 2272 bp, artificial sequence
  plasmid map of pDAB121937
gcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcagatgcagcttttgcaataatttcttctgttgaatcagagggaagtgagagtataggaggaatggataaactgctaccccgcaagatcatgtcagacctggtggtcatgttttcatagattaggtaaaaaaagtccgacatagagtgatgatcatttaaggataatttttttaaagagccacaggttagtagagtggtaggagcagtgttggactgatggctcgcttacataagcagttctgtcccatggagccaatgtcctgatacggtaggacacatatcccttaatgaatcggccaacgcgcggggagaggcggttt

SEQ ID NO: 7567 - DNA, 2220 bp, artificial sequence
  Plasmid map of pDAB124864
gcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggcgttcggaaccgtgctgacccgcaagtggcaacctcccgtgcctctgctcacctttaccgcctggcaactggcggccacctgcagggcgatcgcaccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatcgcctgcagttgctgctttatagacttcaacattattttaactagttatggaaagtttatttaatttgattgcaggcacatcacagatattaatgttgaaagggaattatagacagataccaatgatattgctttttattatacctcaccaaatgattcaaatatgatgtgtcatcccatgtttgttttttcagctaatgaattccctaagaaaagacacatttgctgctttatagactttaatgaatcggccaacgcgcggggagaggcggttt

SEQ ID NO: 7568 - DNA, 110 bp, artificial sequence
  universal domain sequence or analytical domain
gagccacaggttagtagagtggtaggagcagtgttggactgatggctcgcttacataagcagttctgtcccatggagccaatgtcctgatacggtaggacacatatccct

SEQ ID NO: 7569 - DNA, 4505 bp, artificial sequence
  plasmid map of pDAB7221
caaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcatatgaattttcaaataaattatcgcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatattaaaatcccgagaaagcaaaattgcatttaacaaaacagtaatttagtacattaataaaaattatgctcggatggcgcgccgctagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcgtgcgcagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgtacttaattaatgacgtttaaacccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtagatctccatggtgagcaagggcgaggagctgttcaccggggtggtgcccatcctggtcgagctggacggcgacgtgaacggccacaagttcagcgtgtccggcgagggcgagggcgatgccacctacggcaagctgaccctgaagttcatctgcaccaccggcaagctgcccgtgccctggcccaccctcgtgaccaccttcacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccattaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactcacggcatggacgagctgtacaagtaaagcggccgcccgggctgcaggtcgaccatatgggagagct

SEQ ID NO: 7570 - DNA, 21 bp, artificial sequence
  PCR primer
gtcatcataattgctgtccca

SEQ ID NO: 7571 - DNA, 16 bp, artificial sequence
  PCR primer
ggatgtgtgcctgagc

SEQ ID NO: 7572 - DNA, 17 bp, artificial sequence
  PCR primer
ccttcctcgtgccctta

SEQ ID NO: 7573 - DNA, 19 bp, artificial sequence
  PCR primer
cccctaatctcatcgcaag

SEQ ID NO: 7574 - protein, 7 aa, Artificial Sequence
  Zinc Finger Protein Binding Motif
TSSNRKT

SEQ ID NO: 7575 - protein, 7 aa, artificial sequence
  Zinc Finger Protein Binding Motif
RSDELRG

SEQ ID NO: 7576 - protein, 7 aa, Artificial Sequence
  Zinc Finger Protein Binding Motif
RSDTLSA

SEQ ID NO: 7577 - protein, 7 aa, Artificial Sequence
  Zinc Finger Protein Binding Motif
DKSTRTK

SEQ ID NO: 7578 - protein, 7 aa, artificial sequence
  Zinc Finger Protein Binding Motif
DRSTRTK

SEQ ID NO: 7579 - protein, 7 aa, artificial sequence
  Zinc Finger Protein Binding Motif
QSGNLHV

SEQ ID NO: 7580 - protein, 7 aa, artificial sequence
  Zinc Finger Protein Binding Motif
QNAHRKT

SEQ ID NO: 7581 - protein, 7 aa, artificial sequence
  Zinc Finger Protein Binding Motif
QSANRTK

SEQ ID NO: 7582 - protein, 7 aa, artificial sequence
  Zinc Finger Protein Binding Motif
TSGSLSR

SEQ ID NO: 7583 - protein, 7 aa, artificial sequence
  Zinc Finger Protein Binding Motif
FYMQLSR

SEQ ID NO: 7584 - DNA, 35 bp, Zea mays
  misc_feature (15)..(15): n is a, c, g, or t
atacgtcagggttantggttgtttaatgaaaagcc
